(12) United States Patent
Black et al.

(10) Patent No.: US 6,348,328 B1
(45) Date of Patent: Feb. 19, 2002

(54) COMPOUNDS

(75) Inventors: Michael Terence Black, Chester Springs; John Edward Hodgson, Malvern, both of PA (US); David Justin Charles Knowles, Boroughbridge (GB); Richard Oakley Nicholas, Collegeville; Robert King Stodola, Flourtown, both of PA (US)

(73) Assignees: SmithKline Beecham Corporation, Philadelphia, PA (US); SmithKline Beecham plc. (GB)

( * ) Notice: Subject to any disclaimer, the term of this patent is extended or adjusted under 35 U.S.C. 154(b) by 0 days.

(21) Appl. No.: 08/858,207

(22) Filed: May 14, 1997

(51) Int. Cl.$^7$ .................................................. C12P 21/02
(52) U.S. Cl. ................ 435/69.1; 435/320.1; 435/252.3; 536/23.1; 536/23.7
(58) Field of Search ................................ 536/23.4, 23.2, 536/23.7, 23.1; 435/253.3, 252.35, 320.1, 69.1

(56) References Cited

U.S. PATENT DOCUMENTS 5,753,480 A * 5/1998 Lawlor ....................... 435/183
5,756,330 A * 5/1998 Lawlor ....................... 435/183
5,863,777 A * 1/1999 Lawlor ....................... 435/183

FOREIGN PATENT DOCUMENTS

WO          9610647       *  4/1996

OTHER PUBLICATIONS

Critical Synergy: The Biotechnology Industry and Intellectual Property Protection, Biotechnology Industry Organization, Washington, D.C., 1994, pp. 75 and 100–107.*

* cited by examiner

*Primary Examiner*—James Martinell
(74) *Attorney, Agent, or Firm*—Edward R. Gimmi; Thomas S. Deibert; William T. King

(57) ABSTRACT

This invention relates to newly identified polynucleotides, polypeptides encoded by such polynucleotides, the uses of such polynucleotides and polypeptides, as well as the production of such polynucleotides and polypeptides and recombinant host cells transformed with the polynucleotides. This invention also relates to inhibiting the biosynthesis or action of such polynucleotides or polypeptides and to the use of such inhibitors in therapy.

22 Claims, No Drawings

COMPOUNDS

FIELD OF THE INVENTION

This invention relates to newly identified polynucleotides, polypeptides encoded by such polynucleotides, the uses of such polynucleotides and polypeptides, as well as the production of such polynucleotides and polypeptides and recombinant host cells transformed with the polynucleotides. This invention also relates to inhibiting the biosynthesis or action of such polynucleotides or polypeptides and to the use of such inhibitors in therapy. Preferred embodiments of the invention include Streptococcal polypeptides and polynucleotides, particularly those of *Streptococcus pneumoniae*.

BACKGROUND OF THE INVENTION

The Streptococci make up a medically important genera of microbes known to cause several types of disease in humans, including otitis media, pneumonia and meningitis. Since its isolation more than 100 years ago, *Streptococcus pneumoniae* has been one of the more intensively studied microbes. For example, much of our early understanding that DNA is, in fact, the genetic material was predicated on the work of Griffith and of Avery, Macleod and McCarty using this microbe. Despite the vast amount of research with *S. pneumoniae*, many questions concerning the virulence of this microbe remain.

While certain Streptococcal factors associated with pathogenicity have been identified, e.g., capsule polysaccharides, peptidoglycans, pneumolysins, PspA Complement factor H binding component, autolysin, neuraminidase, peptide permeases, hydrogen peroxide, IgA1 protease, the list is certainly not complete. Further very little is known concerning the temporal expression of such genes during infection and disease progression in a mammalian host. Discovering the sets of genes the bacterium is likely to be expressing at the different stages of infection, particularly when an infection is established, provides critical information for the screening and characterization of novel antibacterials which can interrupt pathogenesis. In addition to providing a fuller understanding of known proteins, such an approach will identify previously unrecognised targets.

BRIEF DESCRIPTION OF THE INVENTION

This invention provides novel proteins, particularly those from *Streptococcus pneumoniae*, strain 0100993, characterised in that it comprises the amino acid sequences given herein or fragments, analogues or derivatives thereof.

In accordance with another aspect of the present invention, there are provided polynucleotides (DNA or RNA) which encode such polypeptides.

In particular the invention provides polynucleotides having the DNA sequences given herein.

The invention also relates to novel oligonucleotides derived from the sequences given herein which can act as PCR primers in the process herein described to determine whether or not the *Streptococcus pneumoniae* gene identified herein in whole or in part is expressed in infected tissue. It is recognised that such sequences will also have utility in diagnosis of the stage of infection and type of infection the pathogen has attained. The proteins so identified are also useful as targets in screens designed to identify antimicrobial compounds.

It is an object of the invention to provide polypeptides that have been identified as novel polypeptides by homology between the amino acid sequence set out in the Sequence Listing and a known amino acid sequence or sequences of other proteins such as the proteins identified under the heading Identity in Table 1.

It is a further object of the invention to provide polynucleotides that encode polypeptides set forth in the Sequence Listing, particularly polynucleotides that encode the polypeptide set forth in the Sequence Listing.

In a particularly preferred embodiment of the invention the polynucleotide comprises a region encoding polypeptides comprising the sequence set out in the Sequence Listing, or a variant thereof.

In another particularly preferred embodiment of the invention there is a novel protein from comprising an amino acid sequence of the Sequence Listing, or a variant thereof.

In accordance with another aspect of the invention, there is provided the use of a polynucleotide of the invention for therapeutic or prophylactic purposes, in particular genetic immunization. Among the particularly preferred embodiments of the invention are naturally occurring allelic variants the polynucleotides set forth in the Sequence Listing and polypeptides encoded thereby.

In accordance with yet another aspect of the invention, there are provided inhibitors to such polypeptides, useful as antibacterial agents, including, for example, antibodies.

In accordance with certain preferred embodiments of the invention, there are provided products, compositions and methods for assessing expression of the sequences the Sequence Listing, treating disease, for example, otitis media, conjunctivitis, pneumonia, bacteremia, meningitis, sinusitis, pleural empyema and endocarditis, and most particularly meningitis, such as for example infection of cerebrospinal fluid, assaying genetic variation, and administering a polypeptide or polynucleotide of the invention to an organism to raise an immunological response against a bacteria, especially a *Streptococcus pneumoniae* bacteria In accordance with certain preferred embodiments of this and other aspects of the invention there are provided polynucleotides that hybridize to polynucleotide sequences of the invention, particularly under stringent conditions.

In certain preferred embodiments of the invention there are provided antibodies against polypeptides of the invention.

In other embodiments of the invention there are provided methods for identifying compounds which bind to or otherwise interact with and inhibit or activate an activity of a polypeptide or polynucleotide of the invention comprising: contacting a polypeptide or polynucleotide of the invention with a compound to be screened under conditions to permit binding to or other interaction between the compound and the polypeptide or polynucleotide to assess the binding to or other interaction with the compound, such binding or interaction being associated with a second component capable of providing a detetable signal in response to the binding or interaction of the polypeptide or polynucleotide with the compound; and determining whether the compound binds to or otherwise interacts with and activates or inhibits an activity of the polypetide or polynucleotide by detecting the presence or absence of a signal generated from the binding or interaction of the compound with the polypeptide or polynucleotide.

In accordance with yet another aspect of the invention, there are provided agonists and antagonists of the polynucleotide and/or polypeptides of the invention, preferably bacteriostatic or bacteriocidal agonists and antagonists.

In a further aspect of the invention there are provided compositions comprising a polynucleotide or a polypeptide of the invention for administration to a cell or to a multicellular organism.

Various changes and modifications within the spirit and scope of the disclosed invention will become readily apparent to those skilled in the art from reading the following descriptions and from ring the other parts of the present disclosure.

DETAILED DESCRIPTION OF THE INVENTION

Each of the DNA sequences provided herein may be used in the discovery and development of antibacterial compounds. Because each of the sequences contains an open reading frame (ORF) with appropriate initiation and termination codons, the encoded protein upon expression can be used as a target for the screening of antimicrobial drugs. Additionally, the DNA sequences encoding preferably the amino terminal regions of the encoded protein or the Shine-Delgarno region can be used to construct antisense sequences to control the expression of the coding sequence of interest. Furthermore, many of the sequences disclosed herein also provide regions upstream and downstream from the encoding sequence. These sequences are useful as a source of regulatory elements for the control of bacterial gene expression. Such sequences are conveniently isolated by restriction enzyme action or synthesized chemically and introduced, for example, into promoter identification strains. These strains contain a reporter structural gene sequence located downstream from a restriction site such that if an active promoter is inserted, the reporter gene will be expressed.

Although each of the sequences may be employed as described above, this invention also provides several means for identifying particularly useful target genes. The first of these approaches entails searching appropriate databases for sequence matches in related organisms. Thus, if a homologue exists, the Streptococcal-like form of this gene would likely play an analogous role. For example, a Streptococcal protein identified as homologous to a cell surface protein in another organism would be useful as a vaccine candidate. To the extent such homologies have been identified for the sequences disclosed herein they are reported along with the encoding sequence.

Recently techniques have become available to evaluate temporal gene expression in bacteria, particularly as it applies to viability under laboratory and infection conditions. A number of methods can be used to identify genes which are essential to survival per se, or essential to the establishment/maintenance of an infection. Identification of an ORF unknown by one of these methods yields additional information about its function and permits the selection of such an ORF for further development as a screening target. Briefly, these approaches include:

1) Signature Tagged Mutagenesis (STM)

This technique is described by Hensel et al., *Science* 269: 400–403(1995), the contents of which is incorporated by reference for background purposes. Signature tagged mutagenesis identifies genes necessary for the establishment/maintenance of infection in a given infection model.

The basis of the technique is the random mutagenesis of target organism by various means (e.g., transposons) such that unique DNA sequence tags are inserted in close proximity to the site of mutation. The tags from a mixed population of bacterial mutants and bacteria recovered from an infected hosts are detected by amplification, radiolabeling and hybridisation analysis. Mutants attenuated in virulence are revealed by absence of the tag from the pool of bacteria recovered from infected hosts.

In *Streptococcus pneumoniae*, because the transposon system is less well developed, a more efficient way of creating the tagged mutants is to use the insertion-duplication mutagenesis technique as described by Morrison et al., *J. Bacteriol,* 159:870 (1984) the contents of which is incorporated by reference for background purposes.

2) In Vivo Expression Technology (IVET)

This technique is described by Camilli et Al., i. Proc. Nat'l. Acad. Sci. USA. 91:2634–2638 (1994), the contents of which is incorporated by reference for background purposes. IVET identifies genes unregulated during infection when compared to laboratory cultivation, implying an important role in infection. ORF identified by this technique are implied to have a significant role in infection establishment/maintenance.

In this technique random chromosomal fragments of target organism are cloned upstream of a promoter-less recombinase gene in a plasmid vector. This construct is introduced into the target organism which carries an antibiotic resistance gene flanked by resolvase sites. Growth in the presence of the antibiotic removes from the population those fragments cloned into the plasmid vector capable of supporting transcription of the recombinase gene and therefore have caused loss of antibiotic resistance. The resistant pool is introduced into a host and at various times after infection bacteria may be recovered and assessed for the presence of antibiotic resistance. The chromosomal fragment carried by each antibiotic sensitive bacterium should carry a promoter or portion of a gene normally upregulated during infection. Sequencing upstream of the recombinase gene allows identification of the up regulated gene.

3) Differential Display

This technique is described by Chuang et al., *J. Bacteriol.* 175:2026–2036 (1993), the contents of which is incorporated by reference for background purposes. This method identifies those genes which are expressed in an organism by identifying mRNA present using randomly-primed RT-PCR. By comparing pre-infection and post infection profiles, genes up and down regulated during infection can be identified and the RT-PCR product sequenced and matched to ORF 'unknowns'.

4) Generation of Conditional Lethal Mutants by Transposon Mutagenesis

This technique, described by de Lorenzo, V. et al., *Gene* 123:17–24 (1993); Neuwald, A. F. et al., *Gene* 125: 69–73 (1993); and Takiff, H. E. et al., *J. Bacteriol.* 174:1544–1553 (1992), the contents of which is incorporated by reference for background purposes, identifies genes whose expression are essential for cell viability.

In this technique transposons carrying controllable promoters, which provide transcription outward from the transposon in one or both directions, are generated. Random insertion of these transposons into target organisms and subsequent isolation of insertion mutants in the presence of inducer of promoter activity ensures that insertions which separate promoter from coding region of a gene whose expression is essential for cell viability will be recovered. Subsequent replica plating in the absence of inducer identifies such insertions, since they fail to survive. Sequencing of the flanking regions of the transposon allows identification of site of insertion and identification of the gene disrupted. Close monitoring of the changes in cellular processes/morphology during growth in the absence of inducer yields information on likely function of the gene. Such monitoring could include flow cytometry (cell division, lysis, redox potential, DNA replication), incorporation of radiochemically labeled precursors into DNA, RNA, protein, lipid, peptidoglycan, monitoring reporter enzyme gene fusions which respond to known cellular stresses.

5) Generation of Conditional Lethal Mutants by Chemical Mutagenesis

This technique is described by Beckwith, J., *Methods in Enzymology* 204: 3–18(1991), the contents of which are incorporated herein by reference for background purposes. In this technique random chemical mutagenesis of target organism, growth at temperature other than physiological temperature (permissive temperature) and subsequent replica plating and growth at different temperature (e.g. 42° C. to identify ts, 25° C. to identify cs) are used to identify those isolates which now fail to grow (conditional mutants). As above close monitoring of the changes upon growth at the non-permissive temperature yields information on the function of the mutated gene. Complementation of conditional lethal mutation by library from target organism and sequencing of complementing gene allows matching with unknown ORF.

6) RT-PCR

*Streptococcus pneumoniae* messenger RNA is isolated from bacterial infected tissue e.g. 48 hour murine lung infections, and the amount of each mRNA species assessed by reverse transcription of the RNA sample primed with random hexanucleotides followed by PCR with gene specific primer pairs. The determination of the presence and amount of a particular mRNA species by quantification of the resultant PCR product provides information on the bacterial genes which are transcribed in the infected tissue. Analysis of gene transcription can be carried out at different times of infection to gain a detailed knowledge of gene regulation in bacterial pathogenesis allowing for a clearer understanding of which gene products represent targets for screens for novel antibacterials. Because of the gene specific nature of the PCR primers employed it should be understood that the bacterial mRNA preparation need not be free of mammalian RNA. This allows the investigator to carry out a simple and quick RNA preparation from infected tissue to obtain bacterial mRNA species which are very short lived in the bacterium (in the order of 2 minute halflives). Optimally the bacterial mRNA is prepared from infected murine lung tissue by mechanical disruption in the presence of TRIzole (GIBCO-BRL) for very short periods of time, subsequent processing according to the manufacturers of TRIzole reagent and DNAase treatment to remove contaminating DNA. Preferably the process is optimised by finding those conditions which give a maximum amount of *S. pneumoniae* 16S ribosomal RNA as detected by probing Northerns with a suitably labelled sequence specific oligonucleotide probe. Typically a 5' dye labelled primer is used in each PCR primer pair in a PCR reaction which is terminated optimally between 8 and 25 cycles. The PCR products are separated on 6% polyacrylamide gels with detection and quantification using GeneScanner (manufactured by ABI).

Each of these techniques may have advantages or disadvantage depending on the particular application. The skilled artisan would choose the approach that is the most relevant with the particular end use in mind. For example, some genes might be recognised as essential for infection but in reality are only necessary for the initiation of infection and so their products would represent relatively unattractive targets for antibacterials developed to cure established and chronic infections.

Use of these off technologies when applied to the ORFs of the present invention enables identification of bacterial proteins expressed during infection, inhibitors of which would have utility in anti-bacterial therapy.

*Streptococcus pneumoniae*, strain 0100993 has been deposited at the National Collection of Industrial and Marine Bacteria Ltd. (NCIMB), Aberdeen, Scotland under NCIMB number 40794 on Apr. 11, 1996, and a *Streptococcus pneumoniae*, strain 0100993 DNA library in *E. coli* was similarly deposited on Apr. 17, 1996 under NCIMB number The nucleotide sequences disclosed herein can be obtained by synthetic chemical techniques known in the art or can be obtained from *Streptococcus pneumoniae*, strain 100993 by probing a DNA preparation with probes constructed from the particular sequences disclosed herein. Alternatively, oligonucleotides derived from a disclosed sequence can act as PCR primers in a process of PCR-based cloning of the sequence from a bacterial genomic source. It is recognised that such sequences will also have utility in diagnosis of the stage of infection and type of infection the pathogen has attained.

To obtain the polynucleotide encoding the protein using the DNA sequence given herein typically a library of clones of chromosomal DNA of *Streptococcus pneumoniae*, strain 0100993 in *E. coli* or some other suitable host is probed with a radiolabelled oligonucleotide, preferably a 17 mer or longer, derived from the partial sequence. Clones carrying DNA identical to that of the probe can then be distinguished using high stringency washes. By sequencing the individual clones thus identified with sequencing primers designed from the original sequence it is then possible to extend the sequence in both directions to determine the full gene sequence. Conveniently such sequencing is performed using denatured double stranded DNA prepared from a plasmid clone. Suitable techniques are described by Maniatis, T., Fritsch, E. F. and Sambrook, J. in MOLECULAR CLONING, A Laboratory Manual, 2nd edition, 1989, Cold Spring Harbor Laboratory (see: Screening By Hybridization 1.90 and Sequencing Denatured Double-Stranded DNA Templates 13.70).

A polynucleotide of the present invention may be in the form of RNA or in the form of DNA, which DNA includes cDNA, genomic DNA, and synthetic DNA. The DNA may be double-stranded or single-stranded, and if single stranded may be the coding strand or non-coding (anti-sense) strand. The coding sequence which encodes the polypeptide may be identical to the coding sequence shown or may be a different coding sequence which coding sequence, as a result of the redundancy or degeneracy of the genetic code, encoding the same polypeptide.

The present invention includes variants of the hereinabove described polynucleotides which encode fragments, analogues and derivatives of the polypeptide characterized by the deduced amino acid sequence given herein. The variant of the polynucleotide may be a naturally occurring allelic variant of the polynucleotide or a non-naturally occurring variant of the polynucleotide. In addition to the standard A, G, C, T/U representations for nucleic acid bases, the term "N" is also used. "N" means that any of the four DNA or RNA bases may appear at such a designated position in the DNA or RNA sequence, except that N cannot be a base that when taken in combination with adjacent nucleotide positions, when read in the correct reading frame, would have the effect of generating a premature termination codon in such reading frame.

Thus, the present invention includes polynucleotides encoding the same polypeptide characterized by the deduced amino acid sequence given herein as well as variants of such polynucleotides which variants encode for a fragment, derivative or analogue of the polypeptide. Such nucleotide variants include deletion variants, substitution variants and addition or insertion variants.

The polynucleotide may have a coding sequence which is a naturally occurring allelic variant of the coding sequence characterized by the DNA sequence disclosed herein. As known in the art, an allelic variant is an alternate form of a polynucleotide sequence which may have a substitution, deletion or addition of one or more nucleotides, which does not substantially alter the function of the encoded polypeptide.

The polynucleotide which encodes for the mature polypeptide, may include only the coding sequence for the mature polypeptide or the coding sequence for the mature polypeptide and additional coding sequence such as a leader or secretory sequence or a proprotein sequence.

Thus, the term "polynucleotide encoding a polypeptide" encompasses a polynucleotide which includes only coding sequence for the polypeptide as well as a polynucleotide which includes additional coding and/or non-coding sequence.

The present invention therefore includes polynucleotides, wherein the coding sequence for the mature polypeptide may be fused in the same reading frame to a polynucleotide sequence which aids in expression and secretion of a polypeptide from a host cell, for example, a leader sequence which functions as a secretory sequence for controlling transport of a polypeptide from the cell. The polypeptide having a leader sequence is a preprotein and may have the leader sequence cleaved by the host cell to form the mature form of the polypeptide. The polynucleotides may also encode for a proprotein which is the mature protein plus additional 5' amino acid residues. A mature protein having a prosequence is a proprotein and may be an inactive form of the protein. Once the prosequence is cleaved an active mature protein remains.

Thus, for example, the polynucleotide of the present invention may code for a mature protein, or for a protein having a prosequence or for a protein having both a prosequence and a presequence (leader sequence). Further, the amino acid sequences provided herein show a methionine residue at the $NH_2$-terminus. It is appreciated, however, that during post-translational modification of the peptide, this residue may be deleted. Accordingly, this invention contemplates the use of both the methionine-containing and the methionineless amino terminal variants of each protein disclosed herein.

The polynucleotides of the present invention may also have the coding sequence fused in frame to a marker sequence at either the 5' or 3' terminus of the gene which allows for purification of the polypeptide of the present invention. The marker sequence may be a hexa-histidine tag supplied by the pQE series of vectors (supplied commercially by Quiagen Inc.) to provide for purification of the polypeptide fused to the marker in the case of a bacterial host.

The present invention further relates to polynucleotides which hybridize to the hereinabove-described sequences if there is at least 50% and preferably at least 70% identity between the sequences. The present invention particularly relates to polynucleotides, particularly Streptococcal polynucleotides, which hybridize under stringent conditions to the hereinabove-described polynucleotides . As herein used, the term "stringent conditions" means hybridization will occur only if there is at least 95% and preferably at least 97% identity between the sequences. The polynucleotides which hybridize to the hereinabove described polynucleotides in a preferred embodiment encode polypeptides which retain substantially the same biological function or activity as the polypeptide characterised by the deduced amino acid sequence given herein. An example of stringent hybridization conditions is overnight incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing the hybridization support in 0.1×SSC at about 65° C. Hybridization and wash conditions are well known and exemplified in Sambrook, et al., Molecular Cloning: A Laboratory Manual, Second Edition, Cold Spring Harbor, N.Y., (1989), particularly Chapter 11 therein.

The invention also provides a polynucleotide consisting essentially of a polynucleotide sequence obtainable by screening an appropriate library containing the complete gene for a polynucleotide sequence selected from the group consisting of the polynucleotides of the Sequence Listing under stringent hybridization conditions with a probe having the sequence of said polynucleotide sequence set forth in said polynucleotide of the Sequence Listing or a fragment thereof; and isolating said DNA sequence. Fragments useful for obtaining such a polynucleotide include, for example, probes and primers described elsewhere herein.

"Identity," as known in the art and used herein, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; and Carillo, H., and Lipman, D., SIAM *J. Applied Math,* 48: 1073 (1988). Preferred methods to determine identity are designed to give the largest match between the sequences tested. Methods to determine identity and similarity are codified in publicly available computer programs. Preferred computer program methods to determine identity and similarity between two sequences include, but are not limited to, the GCG program package (Devereux, J., et al., *Nucleic Acids Research* 12(1): 387 (1984)), BLASTP, BLASTN, and FASTA (Atschul, S. F. et al., *J. Molec. Biol.* 215: 403–410 (1990). The BLAST X program is publicly available from NCBI and other sources (*BLAST Manual,* Altschul, S., et al., NCBI NLM NIH Bethesda, Md. 20894; Altschul, S., et al., *J. Mol. Biol.* 215: 403–410 (1990).

As an illustration, by a polynucleotide having a nucleotide sequence having at least, for example, 95% "identity" to a reference nucleotide sequence selected from the group consisting of the polynucleotide of the Sequence Listing is intended that the nucleotide sequence of the polynucleotide is identical to the reference sequence except that the polynucleotide sequence may include up to five point mutations per each 100 nucleotides of the reference nucletide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5 or 3 terminal positions of the reference nucleotide sequence or anywhere between those terminal positions, interspersed either individually among nucleotides in the reference sequence or in one or more contiguous groups within the reference sequence.

Similarly, by a polypeptide having an amino acid sequence having at least, for example, 95% identity to a reference amino acid sequence of selected from the group consisting of the amino acids of the Sequence Listing is intended that the amino acid sequence of the polypeptide is identical to the reference sequence except that the polypeptide sequence may include up to five amino acid alterations per each 100 amino acids of the reference amino acid. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

The deposit referred to herein will be maintained under the terms of the Budapest Treaty on the International Recognition of the Deposit of Micro-organisms for purposes of Patent Procedure. These deposits are provided merely as convenience to those of skill in the art and are not an admission that a deposit is required under 35 U.S.C. §112. The sequence of the polynucleotides contained in the deposited material, as well as the amino acid sequence of the polypeptides encoded thereby, are incorporated herein by reference and are controlling in the event of any conflict with any description of sequences herein. A license may be required to make, use or sell the deposited material, and no such license is hereby granted.

The terms "fragment," "derivative" and "analogue" when referring to the polypeptide characterized by the deduced amino acid sequence herein, means a polypeptide which retains essentially the same biological function or activity as such polypeptide. Thus, an analogue includes a proprotein which can be activated by cleavage of the proprotein portion to produce an active mature polypeptide.

The polypeptide of the present invention may be a recombinant polypeptide, a natural polypeptide or a synthetic polypeptide, preferably a recombinant polypeptide.

The fragment, derivative or analogue of the polypeptide characterized by the deduced amino acid sequence herein may be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which the polypeptide is fused with another compound, such as a compound to increase the half-life of the polypeptide (for example, polyethylene glycol), or (iv) one in which the additional amino acids are fused to the polypeptide, such as a leader or secretory sequence or a sequence which is employed for purification of the polypeptide or a proprotein sequence. Such fragments, derivatives and analogues are deemed to be within the scope of those skilled in the art from the teachings herein.

The polypeptides and polynucleotides of the present invention are preferably provided in an isolated form, and preferably are purified to homogeneity.

The term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

The present invention also relates to vectors which include polynucleotides of the present invention, host cells which are genetically engineered with vectors of the invention and the production of polypeptides of the invention by recombinant techniques.

In accordance with yet a further aspect of the present invention, there is therefore provided a process for producing the polypeptide of the invention by recombinant techniques by expresing a polynucleotide encoding said polypeptide in a host and recovering the expressed product. Alternatively, the polypeptides of the invention can be synthetically produced by conventional peptide synthesizers.

Host cells are genetically engineered (transduced or transformed or transfected) with the vectors of this invention which may be, for example, a cloning vector or an expression vector. The vector may be, for example, in the form of a plasmid, a cosmid, a phage, etc. The engineered host cells can be cultured in conventional nutrient media modified as appropriate for activating promoters, selecting transformants or amplifying the genes. The culture conditions, such as temperature, pH and the like, are those previously used with the host cell selected for expression, and will be apparent to the ordinarily skilled artisan.

Suitable expression vectors include chromosomal, non-chromosomal and synthetic DNA sequences, e.g., bacterial plasmids; phage DNA; baculovirus; yeast plasmids; vectors derived from combinations of plasmids and phage DNA. However, any other vector may be used as long as it is replicable and viable in the host.

The appropriate DNA sequence may be inserted into the vector by a variety of procedures. In general, the DNA sequence is inserted into an appropriate restriction endonuclease site(s) by procedures known in the art.

The DNA sequence in the expression vector is operatively linked to an appropriate expression control sequence(s) (promoter) to direct mRNA synthesis. As representative examples of such promoters, there may be mentioned: LTR or SV40 promoter, the *E. coli* Lac or trp, the phage lambda $P_L$ promoter and other promoters known to control expression of genes in eukaryotic or prokaryotic cells or their viruses. The expression vector also contains a ribosome binding site for translation initiation and a transcription terminator. The vector may also include appropriate sequences for amplifying expression.

In addition, the expression vectors preferably contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

The gene can be placed under the control of a promoter, ribosome binding site (for bacterial expression) and, optionally, an operator (collectively referred to herein as "control" elements), so that the DNA sequence encoding the desired protein is transcribed into RNA in the host cell transformed by a vector containing this expression construction. The coding sequence may or may not contain a signal peptide or leader sequence. The polypeptides of the present invention can be expressed using, for example, the *E. coli* tac promoter or the protein A gene (spa) promoter and signal sequence. Leader sequences can be removed by the bacterial host in post-translational processing. See, e.g., U.S. Pat. Nos. 4,431,739; 4,425,437; 4,338,397. Promoter regions can be selected from any desired gene using CAT (chloramphenicol transferase) vectors or other vectors with selectable markers. Two appropriate vectors are PKK232-8 and PCM7. Particular named bacterial promoters include lac, lacZ, T3, T7, gpt, lambda $P_R$, $P_L$ and trp. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art.

In addition to control sequences, it may be desirable to add regulatory sequences which allow for regulation of the expression of the protein sequences relative to the growth of the host cell. Regulatory sequences are known to those of skill in the art, and examples include those which cause the expression of a gene to be turned on or off in response to a chemical or physical stimulus, including the presence of a regulatory compound. Other types of regulatory elements may also be present in the vector, for example, enhancer sequences.

An expression vector is constructed so that the particular coding sequence is located in the vector with the appropriate regulatory sequences, the positioning and orientation of the coding sequence with respect to the control sequences being such that the coding sequence is transcribed under the "control" of the control sequences (i.e., RNA polymerase which binds to the DNA molecule at the control sequences transcribes the coding sequence). Modification of the coding sequences may be desirable to achieve this end. For example, in some cases it may be necessary to modify the sequence so that it may be attached to the control sequences with the appropriate orientation; i.e., to maintain the reading frame. The control sequences and other regulatory sequences may be ligated to the coding sequence prior to insertion into a vector, such as the cloning vectors described above. Alternatively, the coding sequence can be cloned directly into an expression vector which already contains the control sequences and an appropriate restriction site.

Generally, recombinant expression vectors will include origins of replication and selectable markers permitting transformation of the host cell, e.g., the ampicillin resistance gene of *E. coli* and *S. cerevisiae* TRP1 gene, and a promoter derived from a highly-expressed gene to direct transcription of a downstream structural sequence. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an N-terminal identification peptide imparting desired characteristics, e.g., stabilization or simplified purification of expressed recombinant product.

The vector containing the appropriate DNA sequence as hereinabove described, as well as an appropriate promoter or control sequence, may be employed to transform an appropriate host to permit the host to express the protein.

More particularly, the present invention also includes recombinant constructs comprising one or more of the sequences as broadly described above. The constructs comprise a vector, such as a plasmid or viral vector, into which a sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available. The following vectors are provided by way of example. Bacterial: pET-3 vectors (Stratagene), pQE70, pQE60, pQE-9 (Qiagen), pbs, pD10, phagescript, psiX174, pbluescript SK, pbsks, pNH8A, pNH16a, pNH18A, pNH46A (Stratagene); ptrc99a, pKK223-3, pKK233-3, pDR540, pRIT5 (Pharmacia). Eukaryotic: pBlueBacIII (Invitrogen), pWLNEO, pSV2CAT, pOG$^{44}$, pXT1, pSG (Stratagene) pSVK3, pBPV, pMSG, pSVL (Pharmacia). However, any other plasmid or vector may be used as long as they are replicable and viable in the a host.

Examples of recombinant DNA vectors for cloning and host cells which they can transform include the bacteriophage 1 (*E. coli*), pBR322 (*E. coli*), pACYC177 (*E. coli*), pKT230 (gram-negative bacteria), pGV1106 (gram-negative bacteria), pLAFR1 (gram-negative bacteria), pME290 (non-*E. coli* gram-negative bacteria), pHV14 (*E. coli* and *Bacillus subtilis*), pBD9 (Bacillus), pIJ61 (Streptomyces), pUC6 (Streptomyces), YIp5 (Saccharomyces), a baculovirus insect cell system, YCp19 (Saccharomyces). See, generally, "DNA Cloning": Vols. I & II, Glover et al. ed. IRL Press Oxford (1985) (1987) and; T. Maniatis et al. ("Molecular Cloning" Cold Spring Harbor Laboratory (1982).

In some cases, it may be desirable to add sequences which cause the secretion of the polypeptide from the host organism, with subsequent cleavage of the secretory signal.

Polypeptides can be expressed in host cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., Molecular Cloning: A Laboratory Manual, Second Edition, Cold Spring Harbor, N.Y., (1989), the disclosure of which is hereby incorporated by reference.

Following transformation of a suitable host strain and growth of the host strain to an appropriate cell density, the selected promoter is induced by appropriate means (e.g., temperature shift or chemical induction) and cells are cultured for an additional period.

Cells are typically harvested by centrifugation, disrupted by physical or chemical means, and the resulting crude extract retained for further purification.

Microbial cells employed in expression of proteins can be disrupted by any convenient method, including freeze-thaw cycling, sonication, mechanical disruption, or use of cell lysing agents, such methods are well known to those skilled in the art.

Depending on the expression system and host selected, the polypeptide of the present invention may be produced by growing host cells transformed by an expression vector described above under conditions whereby the polypeptide of interest is expressed. The polypeptide is then isolated from the host cells and purified. If the expression system secretes the polypeptide into growth media, the polypeptide can be purified directly from the media. If the polypeptide is not secreted, it is isolated from cell lysates or recovered from the cell membrane fraction. Where the polypeptide is localized to the cell surface, whole cells or isolated membranes can be used as an assayable source of the desired gene product. Polypeptide expressed in bacterial hosts such as *E. coli* may require isolation from inclusion bodies and refolding. Where the mature protein has a very hydrophobic region which leads to an insoluble product of overexpression, it may be desirable to express a truncated protein in which the hydrophobic region has been deleted. The selection of the appropriate growth conditions and recovery methods are within the skill of the art.

The polypeptide can be recovered and purified from recombinant cell cultures by methods including ammonium sulphate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the mature protein. Finally, high performance liquid chromatography (HPLC) can be employed for final purification steps.

Depending upon the host employed in a recombinant production procedure, the polypeptides of the present invention may be glycosylated or may be non-glycosylated. Polypeptides of the invention may also include an initial methionine amino acid residue.

A "replicon" is any genetic element (e.g., plasmid, chromosome, virus) that functions as an autonomous unit of DNA replication in vivo; i.e., capable of replication under its own control.

A "vector" is a replicon, such as a plasmid, phage, or cosmid, to which another DNA segment may be attached so as to bring about the replication of the attached segment.

A "double-stranded DNA molecule" refers to the polymeric form of deoxyribonucleotides (bases adenine, guanine, thymine, or cytosine) in a double-stranded helix, both relaxed and supercoiled. This term refers only to the primary and secondary structure of the molecule, and does not limit it to any particular tertiary forms. Thus, this term includes double-stranded DNA found, inter-alia, in linear DNA molecules (e.g., restriction fragments), viruses, plasmids, and chromosomes. In discussing the structure of particular double-stranded DNA molecules, sequences may be described herein according to the normal convention of giving only the sequence in the 5' to 3' direction along the nontranscribed strand of DNA (i.e., the strand having the sequence homologous to the mRNA).

A DNA "coding sequence of" or a "nucleotide sequence encoding" a particular protein, is a DNA sequence which is transcribed and translated into a polypeptide when placed under the control of appropriate regulatory sequences.

A "promoter sequence" is a DNA regulatory region capable of binding RNA polymerase in a cell and initiating transcription of a downstream (3' direction) coding sequence. For purposes of defining the present invention, the promoter sequence is bound at the 3' terminus by a translation start codon (e.g., ATG) of a coding sequence and extends upstream (5' direction) to include the minimum number of bases or elements necessary to initiate transcription at levels detectable above background. Within the promoter sequence will be found a transcription initiation site (conveniently defined by mapping with nuclease S1), as well as protein binding domains (consensus sequences) responsible for the binding of RNA polymerase. Eukaryotic promoters will often, but not always, contain "TATA" boxes and "CAT" boxes. Prokaryotic promoters contain Shine-Dalgarno sequences in addition to the −10 and −35 consensus sequences.

DNA "control sequences" refers collectively to promoter sequences, ribosome binding sites, polyadenylation signals, transcription termination sequences, upstream regulatory domains enhancers, and the like, which collectively provide for the expression (i.e., the transcription and translation) of a coding sequence in a host cell.

A control sequence "directs the expression" of a coding sequence in a cell when RNA polymerase will bind the promoter sequence and transcribe the coding sequence into mRNA, which is then translated into the polypeptide encoded by the coding sequence.

A "host cell" is a cell which has been transformed or transfected, or is capable of transformation or transfection by an exogenous DNA sequence.

A cell has been "transformed" by exogenous DNA when such exogenous DNA has been introduced inside the cell membrane. Exogenous DNA may or may not be integrated (covalently linked) into chromosomal DNA making up the genome of the cell. In prokaryotes and yeasts, for example, the exogenous DNA may be maintained on an episomal element, such as a plasmid. With respect to eukaryotic cells, a stably transformed or transfected cell is one in which the exogenous DNA has become integrated into the chromosome so that it is inherited by daughter cells through chromosome replication. This stability is demonstrated by the ability of the eukaryotic cell to establish cell lines or clones comprised of a population of daughter cell containing the exogenous DNA.

A "clone" is a population of cells derived from a single cell or common ancestor by mitosis. A "cell line" is a clone of a primary cell that is capable of stable growth in vitro for many generations.

A "heterologous" region of a DNA construct is an identifiable segment of DNA within or attached to another DNA molecule that is not found in association with the other molecule in nature.

This invention is also related to the use of the polynucleotides of the invention for use as diagnostic reagents. Detection of a polynucleotide or polypeptide of the invention in a eukaryote, particularly a mammal, and especially a human, will provide a diagnostic method for diagnosis of a disease. Eukaryotes (herein also "individual(s)"), particularly mammals, and especially humans, infected with an organism comprising a polynucleotide of the invention may be detected at the nucleic acid level by a variety of techniques.

Nucleic acids for diagnosis may be obtained from an infected individual's cells and tissues, such as bone, blood, muscle, cartilage, and skin. Genomic DNA may be used directly for detection or may be amplified enzymatically by using PCR or other amplification technique prior to analysis. RNA or cDNA may also be used in the same ways. Using amplification, characterization of the species and strain of prokaryote present in an individual, may be made by an analysis of the genotype of the prokaryote gene. Deletions and insertions can be detected by a change in size of the amplified product in comparison to the genotype of a reference sequence. Point mutations can be identified by hybridizing amplified DNA to labeled polynucleotide sequences of the invention. Perfectly matched sequences can be distinguished from mismatched duplexes by RNase digestion or by differences in melting temperatures. DNA sequence differences may also be detected by alterations in the electrophoretic mobility of the DNA fragments in gels, with or without denaturing agents, or by direct DNA sequencing. See, e.g., Myers et al., *Science*, 230: 1242 (1985). Sequence changes at specific locations also may be revealed by nuclease protection assays, such as RNase and S1 protection or a chemical cleavage method. See, e.g., Cotton et al., *Proc. Natl. Acad. Sci*, USA, 85: 4397–4401 (1985).

Cells carrying mutations or polymorphisms in the gene of the invention may also be detected at the DNA level by a variety of techniques, to allow for serotyping, for example. For example, RT-PCR can be used to detect mutations. It is particularly preferred to used RT-PCR in conjunction with automated detection systems, such as, for example, GeneScan. RNA or cDNA may also be used for the same purpose, PCR or RT-PCR. As an example, PCR primers complementary to a nucleic acid encoding a polypeptide of the invention can be used to identify and analyze mutations. These primers may be used for, among other things, amplifying DNA isolated from a sample derived from an individual. The primers may be used to amplify the gene isolated from an infected individual such that the gene may then be subject to various techniques for elucidation of the DNA sequence. In this way, mutations in the DNA sequence may be detected and used to diagnose infection and to serotype and/or classify the infectious agent.

The invention further provides a process for diagnosing, disease, preferably bacterial infections, more preferably infections by *Streptococcus pneumoniae*, comprising determining from a sample derived from an individual a increased level of expression of polynucleotide having a sequence set forth in the Sequence Listing or a sequence of the invention. Increased or decreased expression of a polynucleotide of the invention can be measured using any on of the methods well known in the art for the quantation of polynucleotides, such as, for example, amplification, PCR, RT-PCR, RNase protection, Northern blotting and other hybridization methods.

In addition, a diagnostic assay in accordance with the invention for detecting over-expression of a polypeptide of the invention compared to normal control tissue samples may be used to detect the presence of an infection, for example. Assay techniques that can be used to determine levels of a polypeptide of the invention, in a sample derived from a host are well-known to those of-skill in the art. Such assay methods include radioimmunoassays, competitive-binding assays, Western Blot analysis and ELISA assays.

In accordance with yet a further aspect of the present invention, there is provided the use of a polypeptide of the invention for therapeutic or prophylactic purposes, for example, as an antibacterial agent or a vaccine.

In accordance with another aspect of the present invention, there is provided the use of a polynucleotide of the invention for therapeutic or prophylactic purposes, in particular genetic immunisation.

In accordance with yet another aspect of the present invention, there are provided inhibitors to such polypeptides, useful as antibacterial agents. In particular, there are provided antibodies against such polypeptides.

Polypeptides of the invention may also be used to assess the binding of small molecule substrates and ligands in, for example, cells, cell-free preparations, chemical libraries, and natural product mixtures. These substrates and ligands may be natural substrates and ligands or may be structural or functional mimetics. See, e.g., Coligan et al., *Current Protocols in Immunology* 1(2): Chapter 5 (1991).

The invention also provides a method of screening compounds to identify those which enhance (agonist) or block (antagonist) the action of polypeptides or polynucleotides of the invention, particularly those compounds that are bacteriostatic and/or bacteriocidal. The method of screening may involve high-throughput techniques. For example, to screen for agonists or antagoists, a synthetic reaction mix, a cellular compartment, such as a membrane, cell envelope or cell wall, or a preparation of any thereof, comprising a polypeptide of the invention and a labeled substrate or ligand of such polypeptide is incubated in the absence or the presence of a candidate molecule that may be an agonist or antagonist of a polypeptide of the invention. The ability of the candidate molecule to agonize or antagonize a polypeptide of the invention is reflected in decreased binding of the labeled ligand or decreased production of product from such substrate. Molecules that bind gratuitously, i.e., without inducing the effects of a polypeptide of the invention are most likely to be good antagonists. Molecules that bind well and increase the rate of product production from substrate are agonists. Detection of the rate or level of production of product from substrate may be enhanced by using a reporter system. Reporter systems that may be useful in this regard include but are not limited to colorimetric labeled substrate converted into product, a reporter gene that is responsive to changes in polynucleotide or polypeptide activity, and bindinig assays known in the art.

Another example of an assay for antagonists of a polypeptide of the invention is a competitive assay that conmbines such polypeptide and a potential antagonist with polypeptide-binding molecules, recombinant polypeptide-binding molecules, natural substrates or ligands, or substrate or ligand mimetics, under appropriate conditions for a competitive inhibition assay. Polypeptides of the invention can be labeled, such as by radioactivity or a colorimetric compound, such that the number of such polypeptide molecules bound to a binding molecule or converted to product can be determined accurately to assess the effectiveness of the potential antagonist.

Potential antagonists include small organic molecules, peptides, polypeptides and antibodies that bind to a polynucleotide or polypeptide of the invention and thereby inhibit or extinguish its activity. Potential antagonists also may be small organic molecules, a peptide, a polypeptide such as a closely related protein or antibody that binds the same sites on a binding molecule, without inducing an activities of a polypeptide of the invention, thereby preventing the action of such polypeptide by excluding it from binding.

Potential antagonists include a small molecule that binds to and occupies the binding site of the polypeptide thereby preventing binding to cellular binding molecules, such that normal biological activity is prevented. Examples of small molecules include but are not limited to small organic molecules, peptides or peptide-like molecules. Other potential antagonists include antisense molecules (see Okano, *J. Neurochem.* 56: 560 (1991); OLIGODEOXYNUCLEOTIDES AS ANTISENSE INHIBITORS OF GENE EXPRESSION, CRC Press, Boca Raton, Fla. (1988), for a description of these molecules). Preferred potential antagonists include compounds related to and variants of the polypetides of the invention.

Each of the DNA sequences provided herein may be used in the discovery and development of antibacterial compounds. The encoded protein, upon expression, can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The invention also provides the use of the polypeptide, polynucleotide or inhibitor of the invention to interfere with the initial physical interaction between a pathogen and mammalian host responsible for sequelae of infection. In particular the molecules of the invention may be used: in the prevention of adhesion of bacteria, in particular gram positive bacteria, to mammalian extracellular matrix proteins on in-dwelling devices or to extracellular matrix proteins in wounds; to block protein-mediated mammalian cell invasion by, for example, initiating phosphorylation of mammalian tyrosine kinases (Rosenshine et al., *Infect. Immun.* 60:2211 (1992); to block bacterial adhesion between mammalian extracellular matrix proteins and bacterial proteins that mediate tissue damage and; to block the normal progression of pathogenesis in infections initiated other than by the implantation of in-dwelling devices or by other surgical techniques.

The antagonists and agonists of the invention may be employed, for instance, to inhibit and treat otitis media, conjunctivitis, pneumonia, bacteremia, meningitis, sinusitis, pleural empyema and endocarditis, and most particularly meningitis, such as for example infection of cerebrospinal fluid.

Another aspect of the invention is a pharmaceutical composition comprising the above polypeptide, polynucleotide or inhibitor of the invention and a pharmaceutically acceptable carrier.

In a particular aspect the invention provides the use of an inhibitor of the invention as an antibacterial agent.

The invention further relates to the manufacture of a medicament for such uses.

The polypeptide may be used as an antigen for vaccination of a host to produce specific antibodies which have anti-bacterial action. This invention also contemplates the use of the DNA encoding the antigen as a component in a DNA vaccine as discussed more fully below.

The polypeptides or cells expressing them can be used as an immunogen to produce antibodies thereto. These antibodies can be, for example, polyclonal or monoclonal antibodies. The term antibodies also includes chimeric, single chain, and humanized antibodies, as well as Fab fragments, or the product of an Fab expression library. Various procedures known in the art may be used for the production of such antibodies and fragments.

Antibodies generated against the polypeptides of the present invention can be obtained by direct injection of the polypeptides into an animal or by administering the polypeptides to an animal, preferably a nonhuman. The antibody so obtained will then bind the polypeptides itself. In this manner, even a sequence encoding only a fragment of the polypeptides can be used to generate antibodies binding the whole native polypeptides. Such antibodies can then be used to isolate the polypeptide from tissue expressing that polypeptide.

Polypeptide derivatives include antigenically or immunologically equivalent derivatives which form a particular aspect of this invention.

The term 'antigenically equivalent derivative' as used herein encompasses a polypeptide or its equivalent which will be specifically recognised by certain antibodies which, when raised to the protein or polypeptide according to the present invention, interfere with the interaction between pathogen and mammalian host.

The term 'immunologically equivalent derivative' as used herein encompasses a peptide or its equivalent which when used in a suitable formulation to raise antibodies in a vertebrate, the antibodies act to interfere with the interaction between pathogen and mammalian host.

In particular derivatives which are slightly longer or slightly shorter than the native protein or polypeptide fragment of the present invention may be used. In addition, polypeptides in which one or more of the amino acid residues are modified may be used. Such peptides may, for example, be prepared by substitution, addition, or rearrangement of amino acids or by chemical modification thereof. All such substitutions and modifications are generally well known to those skilled in the art of peptide chemistry.

The polypeptide, such as an antigenically or immunologically equivalent derivative or a fusion protein thereof is used as an antigen to immunize a mouse or other animal such as a rat or chicken. The fusion protein may provide stability to the polypeptide. The antigen may be associated, for example by conjugation, with an immunogenic carrier protein for example bovine serum albumin (BSA) or keyhole limpet haemocyanin (KLH). Alternatively a multiple antigenic peptide comprising multiple copies of the protein or polypeptide, or an antigenically or immunologically equivalent polypeptide thereof may be sufficiently antigenic to improve immunogenicity so as to obviate the use of a carrier.

For preparation of monoclonal antibodies, any technique which provides antibodies produced by continuous cell line cultures can be used. Examples include the hybridoma technique (Kohler and Milstein, *Nature*, 256:495–497 (1975)), the trioma technique, the human B-cell hybridoma technique (Kozbor et al., *Immunology Today* 4:72(1983)), and the EBV-hybridoma technique to produce human monoclonal antibodies (Cole, et al., 1985, in Monoclonal Antibodies and Cancer Therapy, Alan R. Liss, Inc., pp. 77–96).

Techniques described for the production of single chain antibodies (U.S. Pat. No. 4,946,778) can be adapted to produce single chain antibodies to immunogenic polypeptide products of this invention.

Using the procedure of Kohler and Milstein (supra, (1975)), antibody-containing cells from the immunised mammal are fused with myeloma cells to create hybridoma cells secreting monoclonal antibodies.

The hybridomas are screened to select a cell line with high binding affinity and favorable cross reaction with other Streptococcal species using one or more of the original polypeptide and/or the fusion protein. The selected cell line is cultured to obtain the desired Mab.

Hybridoma cell lines secreting the monoclonal antibody are another aspect of this invention.

Alternatively phage display technology could be utilised to select antibody genes with binding activities towards the polypeptide either from repertoires of PCR amplified v-genes of lymphocytes from humans screened for possessing anti-Fbp or from naive libraries (McCafferty, J. et al., *Nature* 348:552–554(1990), and Marks, J. et al., *Biotechnology* 10:779–783(1992)). The affinity of these antibodies can also be improved by chain shuffling (Clackson, T. et al., *Nature* 352:624–628(1991)).

The antibody should be screened again for high affinity to the polypeptide and/or fusion protein.

As mentioned above, a fragment of the final antibody may be prepared.

The antibody may be either intact antibody of $M_r$ approx 150,000 or a derivative of it, for example a Fab fragment or a Fv fragment as described in Skerra, A and Pluckthun, A., *Science* 240:1038–1040 (1988). If two antigen binding domains are present each domain may be directed against a different epitope—termed 'bispecific' antibodies.

The antibody of the invention may be prepared by conventional means for example by established monoclonal antibody technology (Kohler, G. and Milstein, C. (supra (1975) or using recombinant means e.g. combinatorial libraries, for example as described in Huse, W. D. et al., *Science* 246:1275–1281 (1989).

Preferably the antibody is prepared by expression of a DNA polymer encoding said antibody in an appropriate expression system such as described above for the expression of polypeptides of the invention. The choice of vector for the expression system will be determined in part by the host, which may be a prokaryotic cell, such as *E. coli* (preferably strain B) or *Streptomyces sp*. or a eukaryotic cell, such as a mouse C127, mouse myeloma, human HeLa, Chinese hamster ovary, filamentous or unicellular fungi or insect cell. The host may also be a transgenic animal or a transgenic plant (for example, as described in Hiatt, A. et al., *Nature* 340:7678(1989). Suitable vectors include plasmids, bacteriophages, cosmids and recombinant viruses, derived from, for example, baculoviruses and vaccinia.

The Fab fragment may also be prepared from its parent monoclonal antibody by enzyme treatment, for example using papain to cleave the Fab portion from the Fc portion.

Preferably the antibody or derivative thereof is modified to make it less immunogenic in the patient. For example, if the patient is human the antibody may most preferably be 'humanised'; where the complimentarily determining region (s) of the hybridoma-derived antibody has been transplanted into a human monoclonal antibody , for example as described in Jones, P. et al., *Nature* 321:522–525 (1986), or Tempest et al., *Biotechnology* 9:266–273 (1991).

The modification need not be restricted to one of 'humanisation'; other primate sequences (for example Newman, R. et al., *Biotechnology* 10: 1455–1460 (1992)) may also be used.

The humanised monoclonal antibody, or its fragment having binding activity, form a particular aspect of this invention.

This invention provides a method of screening drugs to identify those which interfere with the proteins selected as targets herein, which method comprises measuring the interference of the activity of the protein by a test drug. For example if the protein selected has a catalytic activity, after suitable purification and formulation the activity of the enzyme can be followed by its ability to convert its natural substrates. By incorporating different chemically synthesised test compounds or natural products into such an assay of enzymatic activity one is able to detect those additives which compete with the natural substrate or otherwise inhibit enzymatic activity.

The invention also relates to inhibitors identified thereby.

The use of a polynucleotide of the invention in genetic immunisation will preferably employ a suitable delivery method such as direct injection of plasmid DNA into muscles (Wolff et al., *Hum. Mol. Genet.* 1:363 (1992); Manthorpe et al., *Hum. Gene Ther.* 94:419 (1963)), delivery of DNA complexed with specific protein carriers (Wu et al., *J. Biol. Chem.* 264:16985 (1989)), coprecipitation of DNA with calcium phosphate (Benvenisty & Reshef, *Proc. Nat'l Acad. Sci. USA*, 83:9551 (1986)), encapsulation of DNA in various forms of liposomes (Kaneda et al., *Science* 243:375 (1989)), particle bombardment (Tang et al., *Nature* 356:152 (1992)); Eisenbraun et al., *DNA Cell Biol.* 12:791 (1993)) and in vivo infection using cloned retroviral vectors (Seeger et al., *Proc. Nat'l. Acad. Sci. USA* 81:5849 (1984)). Suitable promoters for muscle transfection include CMV, RSV, SRa, actin, MCK, alpha globin, adenovirus and dihydrofolate reductase.

In therapy or as a prophylactic, the active agent i.e., the polypeptide, polynucleotide or inhibitor of the invention, may be administered to a patient as an injectable composition, for example as a sterile aqueous dispersion, preferably isotonic.

Alternatively the composition may be formulated for topical application for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

For administration to human patients, it is expected that the daily dosage level of the active agent will be from 0.01 to 10 mg/kg, typically around 1 mg/kg. The physician in any event will determine the actual dosage which will be most suitable for an individual patient and will vary with the age, weight and response of the particular patient. The above dosages are exemplary of the average case. There can, of course, be individual instances where higher or lower dosage ranges are merited, and such are within the scope of this invention.

A vaccine composition is conveniently in injectable form. Conventional adjuvants may be employed to enhance the immune response.

A suitable unit dose for vaccination is 0.5–5 μg/kg of antigen, and such dose is preferably administered 1–3 times and with an interval of 1–3 weeks.

Within the indicated dosage range, no adverse toxicologicals effects are expected with the compounds of the invention which would preclude their administration to suitable patients.

The individual full length sequences given herein are summarized in the following Tables (Table 1 and Table 2). Under the column in Table 1 labeled "Identity" there is the deduced identity of each open reading frame of the invention determined using Blastp and/or MPSearch. The ORF# column indicates whether the polynucleotide encoding each ORF encodes more than one ORF. For example, SEQ ID NO: 263 has an ORF#1 but no #2; thus the polynucleotide encodes this ORF#1, but no other ORF was detected. On the other hand, SEQ ID NO:286 and 287 have ORF#s 1 and 2 respectively, indicating that they were both encoded by the same polynucleotide. This can also be seen in Table 2 where the polynucleotide of SEQ ID NO: 24 encodes the ORFs of SEQ ID NOS: 286 and 287. Table 1 also shows in the position ("POSITION"; columns) the start ("START" column) and stop ("STOP" column) codons for each ORF and their positions in the encoding polynucleotide sequence. The SEQ ID NOS of the polypeptides of this table are linked to both a deduced identity in this table and a polynucleotide sequence in Table 2 which encodes each polypeptide. The "Direction" column in Table 1 shows the direction of the ORF encoding each polypeptide in this table. "Forward" denotes the sense orientation and "Reverse" denotes the antisense orientation of the ORF. Table 1 also provides an "Assembly ID" which is a unique numerical descriptor for each polynucleotide sequence of the invention.

TABLE 1

| SEQ ID NO: | IDENTITY | Assembly ID | ORF # | Codon Start | Stop | Position Start | Stop | Direction |
|---|---|---|---|---|---|---|---|---|
| 263. | probable transposase (insertion sequence IS861)- *Streptococcus agalactiae* (strain COH-1) | 3112224 | 1 | ATG | TAA | 258 | 746 | Forward |
| 264. | Unknown | 3112506 | 1 | ~CAT | CTA~ | 414 | 554 | Reverse |
| 265. | SUCCINYL-DIAMINOPIMELATE DESUCCINYLASE (EC 3.5.1.18) (SDAP).- *ESCHERICHIA COLI*. | 3112574 | 1 | ~CAT | TTA~ | 607 | 990 | Reverse |
| 266. | Unknown | 3112646 | 1 | ATG | TGA | 353 | 460 | Forward |
| 267. | D-alanine permease (dagA) homolog- *Haemophilus influenzae* (strain Rd KW20) | 3112686 | 1 | ATG | TAA | 393 | 1235 | Forward |
| 268. | Unknown | 3112810 | 1 | ~CAT | TTA~ | 328 | 468 | Reverse |
| 269. | Unknown | 3112934 | 1 | ATG | TAG | 107 | 739 | Forward |
| 270. | 3-OXOACYL-[ACYL-CARRIER PROTEIN] REDUCTASE PRECURSOR (EC 1.1.1.100) (3-KETOACYL-ACYL CARRIER PROTEIN REDUCTASE).- *CUPHEA LANCEOLATA*. | 3112956 | 1 | ATG | TGA | 586 | 1146 | Forward |
| 271. | HIGH-AFFINITY BRANCHED-CHAIN AMINO ACID TRANSPORT ATP-BINDING PROTEIN LIVG (LIV- I PROTEIN G).- *SALMONELLA TYPHIMURIUM*. | 3112994 | 1 | ATG | TAA | 307 | 648 | Forward |
| 272. | Unknown | 3113026 | 1 | ATG | TGA | 235 | 483 | Forward |
| 273. | Unknown | 3113098 | 1 | ~CAT | TTA~ | 28 | 360 | Reverse |
| 274. | CELL DIVISION PROTEIN FTSH.- *BACILLUS SUBTILIS*. | 3113274 | 1 | ATG | TGA | 125 | 700 | Forward |
| 275. | Unknown | 3113306 | 1 | ~CAT | CTA~ | 255 | 509 | Reverse |
| 276. | PTS SYSTEM, FRUCTOSE-SPECIFIC IIBC COMPONENT EIIBC-FRU) (FRUCTOSE-PERMEASE II BC COMPONENT) (PHOSPHOTRANSFERASE ENZYME II, BC COMPONENT) (EC 2.7.1.69) (EII-FRU).- *XANTHOMONAS CAMPESTRIS* (PV. *CAMPESTRIS*). | 3113406 | 1 | ~CAT | TCA~ | 237 | 725 | Reverse |
| 277. | Unknown | 3113432 | 1 | ~CAT | CTA~ | 17 | 310 | Reverse |
| 278. | Unknown | 3113436 | 1 | CTG | TAA | 1 | 441 | Forward |
| 279. | HOLLIDAY JUNCTION DNA HELICASE RUVB.- *ESCHERICHIA COLI*. | 3113510 | 1 | ATG | TGA | 187 | 411 | Forward |
| 280. | Unknown | 3113514 | 1 | ATG | TGA | 361 | 495 | Forward |
| 281. | Unknown | 3113546 | 1 | TTG | TAA | 2 | 241 | Forward |
| 282. | CELL DIVISION PROTEIN FTSA.- *BACILLUS SUBTILIS*. | 3113610 | 1 | TTG | TGA | 3 | 665 | Forward |
| 283. | Unknown | 3113692 | 1 | ATG | TAG | 304 | 594 | Forward |
| 284. | GALACTOSE-6-PHOSPHATE ISOMERASE LACB SUBUNIT (EC 5.-.-.-).- *LACTOCOCCUS LACTIS* (SUBSP. *LACTIS*) (*STREPTOCOCCUS LACTIS*). | 3113696 | 1 | ATG | TGA | 176 | 661 | Forward |
| 285. | 3-ISOPROPYLMALATE DEHYDROGENASE (EC 1.1.1.85) (BETA-IPM DEHYDROGENASE) (IMDH).- *LACTOCOCCUS LACTIS* (SUBSP. *LACTIS*) (*STREPTOCOCCUS LACTIS*). | 3113762 | 1 | ~CAG | TTA~ | 275 | 508 | Reverse |
| 286. | PHOSPHO-2-DEHYDRO-3-DEOXYHEPTONATE ALDOLASE (EC 4.1.2.15) (PHOSPHO-2-KETO-3-DEOXYHEPTONATE ALDOLASE) (DAHP SYNTHETASE) (3-DEOXY-D-ARABINO-HEPTULOSONATE 7-PHOSPHATE SYNTHASE).- *CORYNEBACTERIUM GLUTAMICUM*. | 3113794 | 1 | ATG | TAG | 40 | 219 | Forward |
| 287. | PHOSPHO-2-DEHYDRO-3-DEOXYHEPTONATE ALDOLASE, PHE-SENSITIVE (EC 4.1.2.15) (PHOSPHO-2-KETO-3-DEOXYHEPTONATE ALDOLASE) (DAHP SYNTHETASE) (3-DEOXY-D-ARABINO-HEPTULOSONATE 7-PHOSPHATE SYNTHASE).- *ESCHERICHIA COLI*. | 3113794 | 2 | ATG | TGA | 283 | 453 | Forward |
| 288. | PYRUVATE KINASE (EC 2.7.1.40).- *LACTOCOCCUS LACTIS* (SUBSP. *LACTIS*) (*STREPTOCOCCUS LACTIS*). | 3113802 | 1 | ATG | TGA | 69 | 260 | Forward |
| 289 | Unknown | 3113990 | 1 | ~CAT | TTA~ | 6 | 164 | Reverse |
| 290. | ADAPTIVE-RESPONSE SENSORY-KINASE SASA (EC 2.7.-.-).- *SYNECHOCOCCUS SP.* (STRAIN PCC 7942) (*ANACYSTIS NIDULANS* R2). | 3114082 | 1 | ATG | TAG | 22 | 189 | Forward |

TABLE 1-continued

| SEQ ID NO: | IDENTITY | Assembly ID | ORF # | Codon Start | Stop | Position Start | Stop | Direction |
|---|---|---|---|---|---|---|---|---|
| 291. | FOLYLPOLYGLUTAMATE SYNTHASE (EC 6.3.2.17) (FOLYLPOLY-GAMMA-GLUTAMATE SYNTHETASE) (FPGS).- *LACTOBACILLUS CASEI*. | 3114096 | 1 | CTG | TGA | 1 | 243 | Forward |
| 292. | 50S RIBOSOMAL PROTEIN L6 (BL10).- *BACILLUS STEAROTHERMOPHILUS*. | 3174146 | 1 | ~CAT | TCA~ | 581 | 949 | Reverse |
| 293. | grpE protein- *Lactococcus lactis* | 3174148 | 1 | ~CAT | TTA~ | 256 | 780 | Reverse |
| 294. | Unknown | 3174150 | 1 | ~CAT | TCA~ | 347 | 472 | Reverse |
| 295. | ribosomal protein S14 (rpS14) homolog- *Haemophilus influenzae* (strain Rd KW20) | 3174152 | 1 | ~CAT | TTA~ | 137 | 391 | Reverse |
| 296. | 50S RIBOSOMAL PROTEIN L3.- *BACILLUS STEAROTHERMOPHILUS*. | 3174154 | 1 | ATG | TAA | 441 | 1067 | Forward |
| 297. | PHOSPHATE TRANSPORT SYSTEM REGULATORY PROTEIN.- *ESCHERICHIA COLI*. | 3174166 | 1 | ~CAT | TTA~ | 101 | 751 | Reverse |
| 298. | PROBABLE TRANSKETOLASE (EC 2.2.1.1) (TK).- *STREPTOCOCCUS PNEUMONIAE*. | 3174184 | 2 | ~CAT | TTA~ | 895 | 1350 | Reverse |
| 299. | ntpJ protein- *Enterococcus hirae* | 3174206 | 1 | TTG | TAG | 2 | 763 | Forward |
| 300. | Unknown | 3174208 | 1 | ATG | TAA | 311 | 1054 | Forward |
| 301. | Unknown | 3174210 | 1 | ~CAT | TTA~ | 290 | 2305 | Reverse |
| 302. | ACYL CARRIER PROTEIN.- *CRYPTOMONAS PHI*. | 3174220 | 1 | ATG | TAG | 788 | 1021 | Forward |
| 303. | ISL2 protein- *Lactobacillus helveticus* | 3174224 | 1 | ~CAT | TTA~ | 447 | 737 | Reverse |
| 304. | ISL2 protein- *Lactobacillus helveticus* | 3174226 | 1 | ATG | TAG | 850 | 1164 | Forward |
| 305. | Unknown | 3174228 | 1 | CTG | TAA | 1 | 240 | Forward |
| 306. | Unknown | 3174228 | 2 | ATG | TAG | 278 | 580 | Forward |
| 307. | Possible Ca2+-transporting ATPase | 3174236 | 1 | ~CAT | TTA~ | 53 | 241 | Reverse |
| 308. | Possible Ca2+-transporting ATPase | 3174238 | 1 | ~CAT | TTA~ | 53 | 529 | Reverse |
| 309. | CATION-TRANSPORTING ATPASE PACL (EC 3.6.1.-).- SYNECHOCOCCUS SP. (STRAIN PCC 7 942) (*ANACYSTIS NIDULANS* R2). | 3174238 | 2 | ~CAT | TCA~ | 549 | 1298 | Reverse |
| 310. | PROLYL-TRNA SYNTHETASE (EC 6.1.1.15) (PROLINE--TRNA LIGASE) (PRORS) (GLOBAL RNA SYNTHESIS FACTOR).- *ESCHERICHIA COLI*. | 3174270 | 1 | ~CAT | TTA~ | 150 | 1646 | Reverse |
| 311. | Unknown | 3174278 | 1 | ATG | TGA | 733 | 867 | Forward |
| 312. | Unknown | 3174278 | 2 | ATG | TAA | 1680 | 1880 | Forward |
| 313. | PROLYL-TRNA SYNTHETASE (EC 6.1.1.15) (PROLINE--TRNA LIGASE) (PRORS) (GLOBAL RNA SYNTHESIS FACTOR).- *ESCHERICHIA COLI*. | 3174284 | 1 | ATG | TAA | 1009 | 2103 | Forward |
| 314. | BSCELABCD NCBI gi: 8957- *Bacillus subtilis*. | 3174288 | 1 | ATG | TAA | 78 | 464 | Forward |
| 315. | GLUTAMINE TRANSPORT ATP-BINDING PROTEIN GLNQ.- *ESCHERICHIA COLI*. | 3174294 | 1 | ATG | TGA | 370 | 981 | Forward |
| 316. | Unknown | 3174294 | 2 | ATG | TAA | 1044 | 1217 | Forward |
| 317. | GLUTAMINE TRANSPORT ATP-BINDING PROTEIN GLNQ.- *BACILLUS STEAROTHERMOPHILUS*. | 3174298 | 1 | ATG | TAA | 431 | 976 | Forward |
| 318. | GLUTAMINE TRANSPORT ATP-BINDING PROTEIN GLNQ.- *BACILLUS STEAROTHERMOPHILUS*. | 3174298 | 2 | ATG | TAA | 922 | 1179 | Forward |
| 319. | Unknown | 3174302 | 1 | ~CAT | TTA~ | 322 | 1320 | Reverse |
| 320. | Unknown | 3174302 | 2 | ~CAT | CTA~ | 1486 | 1857 | Reverse |
| 321. | Unknown | 3174314 | 1 | ATG | TGA | 523 | 891 | Forward |
| 322. | Unknown | 3174314 | 2 | ATG | TAG | 888 | 1370 | Forward |
| 323. | RIBOFLAVIN SYNTHASE ALPHA CHAIN (EC 2.5.1.9).- *BACILLUS SUBTILIS*. | 3174328 | 1 | ~CAT | CTA~ | 213 | 653 | Reverse |
| 324. | 5,10-METHYLENETETRAHYDROFOLATE REDUCTASE (EC 1.7.99.5).- *SALMONELLA TYPHIMURIUM*. | 3174342 | 1 | ATG | TAA | 372 | 1238 | Forward |
| 325. | Unknown | 3174356 | 1 | ~CAA | TCA~ | 584 | 1342 | Reverse |
| 326. | LSSAKACNP NCBI gi: 695615- *Lactobacillus sake*. | 3174368 | 1 | ATG | TAA | 219 | 539 | Forward |
| 327. | agrB protein- *Staphylococcus aureus* | 3174368 | 2 | ATG | TGA | 730 | 1056 | Forward |
| 328. | RESD PROTEIN.- *BACILLUS SUBTILIS*. | 3174372 | 1 | CTG | TGA | 1 | 315 | Forward |
| 329. | PROBABLE TRANSCRIPTIONAL REGULATORY PROTEIN ENDR.- *BACILLUS POLYMYXA*. | 3174384 | 1 | ~CAT | TCA~ | 239 | 418 | Reverse |
| 330. | Unknown | 3174384 | 2 | ~CAT | CTA~ | 514 | 1074 | Reverse |
| 331. | 30S RIBOSOMAL PROTEIN S2.- *ESCHERICHIA COLI*. | 3174390 | 1 | ATG | TAA | 597 | 1457 | Forward |

TABLE 1-continued

| SEQ ID NO: | IDENTITY | Assembly ID | ORF # | Codon Start | Stop | Position Start | Stop | Direction |
|---|---|---|---|---|---|---|---|---|
| 332. | GLUTAMINE TRANSPORT ATP-BINDING PROTEIN GLNQ.- *ESCHERICHIA COLI*. | 3174402 | 1 | ATG | TGA | 372 | 980 | Forward |
| 333. | GTP-BINDING PROTEIN ERA HOMOLOG.- *STREPTOCOCCUS MUTANS*. | 3174420 | 1 | ~CAT | TTA~ | 592 | 1086 | Reverse |
| 334. | GTP-BINDING PROTEIN ERA HOMOLOG.- *STREPTOCOCCUS MUTANS*. | 3174420 | 2 | ~CAT | TTA~ | 1022 | 1492 | Reverse |
| 335. | SULFATE TRANSPORT ATP-BINDING PROTEIN CYSA.- SYNECHOCOCCUS SP. (STRAIN PCC 794 2) (*ANACYSTIS NIDULANS* R2). | 3174426 | 1 | ATG | TGA | 812 | 1270 | Forward |
| 336. | NITRATE TRANSPORT PROTEIN NASD. *KLEBSIELLA PNEUMONIAE*. | 3174426 | 2 | ATG | TAG | 1298 | 1543 | Forward |
| 337. | PROLIPOPROTEIN DIACYLGLYCERYL TRANSFERASE (EC 2.4.99.-).- *SALMONELLA TYPHIMURIUM*. | 3174428 | 1 | ~CAT | TTA~ | 35 | 835 | Reverse |
| 338. | Unknown | 3174444 | 1 | ATG | TAA | 164 | 895 | Forward |
| 339. | CYSTEINYL-TRNA SYNTHETASE (EC 6.1.1.16) (CYSTEINE--TRNA LIGASE) (CYSRS).- *BACILLUS SUBTILIS*. | 3174454 | 1 | ~CAT | TCA~ | 504 | 1079 | Reverse |
| 340. | Unknown | 3174460 | 1 | ATG | TAG | 529 | 1275 | Forward |
| 341. | PRIMOSOMAL PROTEIN N' (REPLICATION FACTOR Y).- *ESCHERICHIA COLI*. | 3174462 | 1 | TTG | TGA | 2 | 721 | Forward |
| 342. | 30S RIBOSOMAL PROTEIN S11 (BS11).- *BACILLUS SUBTILIS*. | 3174466 | 1 | ~CAT | TTA~ | 1019 | 1303 | Reverse |
| 343. | Unknown | 3174474 | 1 | ~CAT | TTA~ | 238 | 423 | Reverse |
| 344. | Unknown | 3174476 | 1 | ~CAT | TTA~ | 241 | 1446 | Reverse |
| 345. | PEPTIDE CHAIN RELEASE FACTOR 3 (RF-3).- *BACTEROIDES NODOSUS* (*DICHELOBACTER NODOSUS*). | 3174490 | 1 | ~CAT | CTA~ | 668 | 1291 | Reverse |
| 346. | mesI protein- *Leuconostoc mesenteroides* | 3174496 | 1 | ATG | TAG | 812 | 1666 | Forward |
| 347. | Unknown | 3174506 | 1 | ATG | TGA | 179 | 352 | Forward |
| 348. | GALACTOKINASE (EC 2.7.1.6).- *LACTOBACILLUS HELVETICUS*. | 3174514 | 1 | ~CAT | TCA~ | 209 | 340 | Reverse |
| 349. | GALACTOKINASE (EC 2.7.1.6).- *BACILLUS SUBTILIS*. | 3174514 | 2 | ~CAT | TTA~ | 1177 | 1359 | Reverse |
| 350. | FORMATE ACETYLTRANSFERASE 1 (EC 2.3.1.54) (PYRUVATE FORMATE-LYASE 1).- *ESCHERICHIA COLI*. | 3174524 | 1 | ~CAT | TTA~ | 19 | 867 | Reverse |
| 351. | Unknown | 3174546 | 1 | ~CAT | CTA~ | 912 | 1127 | Reverse |
| 352. | CACSPC NCBI gi: 899232- *Clostridium acetobutylicum*. | 3174550 | 1 | ATG | TAG | 645 | 956 | Forward |
| 353. | Unknown | 3174562 | 1 | CTG | TAG | 1 | 504 | Forward |
| 354. | KETOACYL REDUCTASE HETN (EC 1.3.1.-).- ANABAENA SP. (STRAIN PCC 7120). | 3174562 | 2 | ATG | TAA | 525 | 1280 | Forward |
| 355. | Unknown | 3174570 | 1 | ATG | TAG | 249 | 593 | Forward |
| 356. | ATP-DEPENDENT DNA HELICASE RECG (EC 3.6.1.-).- *ESCHERICHIA COLI*. | 3174570 | 2 | ATG | TGA | 604 | 1695 | Forward |
| 357. | PROTEIN DLTD PRECURSOR.- *BACILLUS SUBTILIS*. | 3174580 | 1 | ATG | TGA | 3 | 611 | Forward |
| 358. | ALANYL-TRNA SYNTHETASE (EC 6.1.1.7) (ALANINE--TRNA LIGASE) (ALARS).- *ESCHERICHIA COLI*. | 3174582 | 1 | ATG | TGA | 537 | 875 | Forward |
| 359. | PTS SYSTEM, MANNOSE-SPECIFIC IIC COMPONENT (EIIC-MAN) (MANNOSE-PERMEASE IIC COMPONENT) (PHOSPHOTRANSFERASE ENZYME II, C COMPONENT) (EII-P-MAN).- *ESCHERICHIA COLI*. | 3174586 | 1 | ATG | TGA | 533 | 865 | Forward |
| 360. | PTS SYSTEM, FRUCTOSE-SPECIFIC IIC COMPONENT (EIIC-FRU) (FRUCTOSE-PERMEASE IIC COMPONENT) (PHOSPHOTRANSFERASE ENZYME II, C COMPONENT) (P28).- *BACILLUS SUBTILIS*. | 3174586 | 2 | ATG | TAA | 747 | 1172 | Forward |
| 361. | URIDYLATE KINASE (EC 2.7.4.-) (UK) (URIDINE MONOPHOSPHATE KINASE) (UMP KINASE) (SMBA PROTEIN).- *ESCHERICHIA COLI*. | 3174594 | 1 | ~CAT | TTA~ | 319 | 579 | Reverse |
| 362. | Unknown | 3174606 | 1 | CTG | TAA | 1 | 153 | Forward |
| 363. | Unknown | 3174608 | 1 | ATG | TAA | 336 | 863 | Forward |
| 364. | Unknown | 3174634 | 1 | ~CAT | CTA~ | 99 | 308 | Reverse |
| 365. | Unknown | 3174634 | 2 | ~CAT | TCA~ | 305 | 826 | Reverse |
| 366. | 5-METHYLTETRAHYDROPTER-OYLTRIGLUTAMATE-- HOMOCYSTEINE METHYLTRANSFERASE (EC 2.1.1 .14) | 3174642 | 1 | ~CAT | TCA~ | 250 | 1620 | Reverse |

TABLE 1-continued

| SEQ ID NO: | IDENTITY | Assembly ID | ORF # | Codon Start | Stop | Position Start | Stop | Direction |
|---|---|---|---|---|---|---|---|---|
| | (METHIONINE SYNTHASE, VITAMIN-B12 INDEPENDENT ISOZYME).- ESCHERICHIA COLI. | | | | | | | |
| 367. | HIGH-AFFINITY BRANCHED-CHAIN AMINO ACID TRANSPORT ATP-BINDING PROTEIN BRAF.- PSEUDOMONAS AERUGINOSA. | 3174644 | 1 | ATG | TGA | 283 | 765 | Forward |
| 368. | Unknown | 3174652 | 1 | ATG | TGA | 913 | 1134 | Forward |
| 369. | Unknown | 3174654 | 1 | ATG | TGA | 158 | 319 | Forward |
| 370. | ADENYLOSUCCINATE LYASE (EC 4.3.2.2) (ADENYLOSUCCINASE) (ASL).- BACILLUS SUBTILIS. | 3174658 | 1 | ~CAT | TTA~ | 941 | 1477 | Reverse |
| 371. | Unknown | 3174660 | 1 | ATG | TGA | 454 | 594 | Forward |
| 372. | Unknown | 3174662 | 1 | ~CAT | TCA~ | 103 | 768 | Reverse |
| 373. | 50S RIBOSOMAL PROTEIN L16.- MYCOPLASM ACAPRICOLUM. | 3174664 | 1 | ATG | TAA | 33 | 446 | Forward |
| 374. | STAGE V SPORULATION PROTEIN E.- BACILLUS SUBTILIS. | 3174666 | 1 | ATG | TAG | 151 | 816 | Forward |
| 375. | Unknown | 3174676 | 1 | ~CAT | CTA~ | 24 | 359 | Reverse |
| 376. | Unknown | 3174678 | 1 | ~CAT | TCA~ | 1 | 207 | Reverse |
| 377. | Unknown | 3174714 | 1 | ATG | TAA | 839 | 1363 | Forward |
| 378. | ATP-DEPENDENT CLP PROTEASE ATP-BINDING SUBUNIT CLPX.- ESCHERICHIA COLI. | 3174736 | 1 | CTG | TGA | 3 | 317 | Forward |
| 379. | ATP-DEPENDENT CLP PROTEASE ATP-BINDING SUBUNIT CLPX.- ESCHERICHIA COLI. | 3174736 | 2 | ATG | TAG | 411 | 797 | Forward |
| 380. | Unknown | 3174738 | 1 | ATG | TAA | 184 | 558 | Forward |
| 381. | Unknown | 3174744 | 1 | ATG | TAA | 507 | 1082 | Forward |
| 382. | PYRROLIDONE-CARBOXYLATE PEPTIDASE (EC 3.4.19.3) (5-OXOPROLYL-PEPTIDASE).- STREPTOCOCCUS PYOGENES. | 3174748 | 1 | ATG | TAA | 218 | 691 | Forward |
| 383. | Unknown | 3174748 | 2 | ATG | TGA | 693 | 875 | Forward |
| 384. | Unknown | 3174760 | 1 | ATG | TGA | 280 | 495 | Forward |
| 385. | Unknown | 3174770 | 1 | ATG | TGA | 226 | 402 | Forward |
| 386. | RECOMBINATION PROTEIN.- BACILLUS SUBTILIS. | 3174772 | 1 | ATG | TAA | 898 | 1527 | Forward |
| 387. | ALPHA-ACETOLACTATE DECARBOXYLASE (EC 4.1.1.5).- ENTEROBACTER AEROGENES (AEROBACTER AEROGENES). | 3174774 | 1 | ATG | TAG | 155 | 550 | Forward |
| 388. | 3-ISOPROPYLMALATE DEHYDRATASE (EC 4.2.1.33) (ISOPROPYLMALATE ISOMERASE) (ALPHA- IPM ISOMERASE).- LACTOCOCCUS LACTIS (SUBSP. LACTIS) (STREPTOCOCCUS LACTIS). | 3174784 | 1 | ATG | TAG | 291 | 650 | Forward |
| 389. | peptide chain release factor 1- Bacillus subtilis | 3174802 | 1 | ATG | TAA | 293 | 1372 | Forward |
| 390. | ATP-dependent Clp proteinase (EC 3.4.21.-) chain clpL- Lactococcus lactis subsp. lactis plasmid pUCL22 | 3174806 | 1 | ~CAT | CTA~ | 592 | 1194 | Reverse |
| 391. | Unknown | 3174812 | 1 | ATG | TAA | 55 | 933 | Forward |
| 392. | FAD synthase (EC 6.3.-.-)- Corynebacterium ammoniagenes | 3174818 | 1 | ~CAT | TTA~ | 4 | 921 | Reverse |
| 393. | CYTIDINE DEAMINASE (EC 3.5.4.5) (CYTIDINE AMINOHYDROLASE) (CDA).- BACILLUS SUBTILIS. | 3174826 | 1 | ATG | TAG | 25 | 414 | Forward |
| 394. | Unknown | 3174832 | 1 | ~CAT | TTA~ | 23 | 382 | Reverse |
| 395. | Unknown | 3174838 | 1 | ATG | TAA | 184 | 540 | Forward |
| 380. | SARPLRPO NCBI gi: 677848NCBI gi: 473748- Staphylococcus aureus. | 3174842 | 1 | ~CAT | TCA~ | 299 | 574 | Reverse |
| 381. | Unknown | 3174852 | 1 | ~CAT | TCA~ | 181 | 540 | Reverse |
| 382. | TRK SYSTEM POTASSIUM UPTAKE PROTEIN TRKA HOMOLOG.- METHANOSARCINA MAZEI. | 3174858 | 1 | CTG | TGA | 1 | 1077 | Forward |
| 383. | Unknown | 3174870 | 1 | ~CAT | CTA~ | 228 | 953 | Reverse |
| 384. | 6-PHOSPHO-BETA-GALACTOSIDASE (EC 3.2.1.85) (BETA-D-PHOSPHOGALACTO- SIDE GALACTOHYDROLASE).- LACTOCOCCUS LACTIS (SUBSP. LACTIS) (STREPTOCOCCUS LACTIS). | 3174878 | 1 | ~CAT | TCA~ | 227 | 667 | Reverse |
| 385. | hemolytic factor- Bacillus cereus | 3174926 | 1 | ~CAT | TCA~ | 591 | 1142 | Reverse |
| 386. | DIPEPTIDYL PEPTIDASE IV (EC 3.4.14.5) (X-PROLYL DIPEPTIDYL AMINOPEPTIDASE IV) (X-PDAP).- | 3174936 | 1 | ATG | TAA | 189 | 479 | Forward |

TABLE 1-continued

| SEQ ID NO: | IDENTITY | Assembly ID | ORF # | Codon Start | Stop | Position Start | Stop | Direction |
|---|---|---|---|---|---|---|---|---|
| | LACTOCOCCUS LACTIS (SUBSP. CREMORIS) (STREPTOCOCCUS CREMORIS). | | | | | | | |
| 387. | ARGININE HYDROXIMATE RESISTANCE PROTEIN.- BACILLUS SUBTILIS. | 3174936 | 2 | ATG | TGA | 496 | 846 | Forward |
| 388. | Unknown | 3174938 | 1 | ATG | TGA | 366 | 587 | Forward |
| 389. | Unknown | 3174946 | 1 | ~CAT | CTA~ | 111 | 380 | Reverse |
| 390. | Unknown | 3174952 | 1 | ~CAT | TTA~ | 37 | 819 | Reverse |
| 391. | DnaK protein- Lactococcus lactis | 3174970 | 1 | CTG | TGA | 3 | 380 | Forward |
| 392. | Unknown | 3174990 | 1 | ATG | TAA | 141 | 1058 | Forward |
| 409. | LACALS NCBI gi: 473900- Lactococcus lactis (strain DSM 20384, sub-species lactis) DNA. | 3175000 | 1 | ATG | TAA | 794 | 1015 | Forward |
| 410. | Unknown | 3175006 | 1 | ATG | TGA | 56 | 631 | Forward |
| 411. | cellobiose phosphotransferase system celA- Bacillus stearothermophilus | 3175006 | 2 | ATG | TAA | 646 | 963 | Forward |
| 412. | Unknown | 3175010 | 1 | ~CAT | TTA~ | 13 | 231 | Reverse |
| 413. | Unknown | 3175014 | 1 | ATG | TGA | 58 | 219 | Forward |
| 414. | Unknown | 3175016 | 1 | ATG | TAA | 120 | 503 | Forward |
| 415. | Unknown | 3175032 | 1 | ATG | TAA | 364 | 669 | Forward |
| 416. | Unknown | 3175046 | 1 | ATG | TGA | 105 | 401 | Forward |
| 417. | GLYCYL-TRNA SYNTHETASE ALPHA CHAIN (EC 6.1.1.14) (GLYCINE-- TRNA LIGASE ALPHA CHAIN) (GLYRS).- ESCHERICHIA COLI. | 3175074 | 1 | ~CAT | CTA~ | 107 | 787 | Reverse |
| 418. | GLYCYL-TRNA SYNTHETASE ALPHA CHAIN (EC 6.1.1.14) (GLYCINE-- TRNA LIGASE ALPHA CHAIN) (GLYRS).- ESCHERICHIA COLI. | 3175074 | 2 | ~CAT | TCA~ | 787 | 936 | Reverse |
| 419. | endopeptidase PepO (EC 3.4.-.-)- Lactococcus lactis subsp. lactis | 3175092 | 1 | ~CAT | TTA~ | 47 | 490 | Reverse |
| 420. | BSCELABCD NCBI gi: 895746- Bacillus subtilis. | 3175094 | 1 | ~CAT | CTA~ | 303 | 1019 | Reverse |
| 421. | DNA LIGASE (EC 6.5.1.2) (POLYDEOXY RIBONUCLEOTIDE SYNTHASE (NAD+)).- ESCHERICHIA COLI. | 3175098 | 1 | ATG | TAA | 134 | 265 | Forward |
| 422. | Unknown | 3175098 | 2 | ATG | TAA | 210 | 446 | Forward |
| 423. | TAGATOSE 1,6-DIPHOSPHATE ALDOLASE (EC 4.1.-.-).- LACTOCOCCUS LACTIS (SUBSP. LACTIS) (STREPTOCOCCUS LACTIS). | 3175102 | 1 | ATG | TGA | 495 | 950 | Forward |
| 424. | Unknown | 3175104 | 1 | CTG | TAA | 1 | 525 | Forward |
| 425. | Unknown | 3175114 | 1 | ~CAT | TTA~ | 59 | 508 | Reverse |
| 426. | Unknown | 3175126 | 1 | ATG | TAA | 3 | 203 | Forward |
| 427. | Unknown | 3175136 | 1 | ATG | TGA | 370 | 582 | Forward |
| 428. | Unknown | 3175138 | 1 | ~CAG | TCA~ | 1134 | 1448 | Reverse |
| 429. | 2-ISOPROPYLMALATE SYNTHASE (EC 4.1.3.12) (ALPHA-ISOPROPYL- MALATE SYNTHASE) (ALPHA-IPM SYNTHETASE).- LACTOCOCCUS LACTIS (SUBSP. LACTIS) (STREPTOCOCCUS LACTIS). | 3175140 | 1 | ATG | TAA | 963 | 1382 | Forward |
| 430. | LPLC PROTEIN.- BACILLUS SUBTILIS. | 3175150 | 1 | ~CAT | TCA~ | 246 | 827 | Reverse |
| 431. | Unknown | 3175158 | 1 | ~CAT | TTA~ | 114 | 407 | Reverse |
| 432. | PROTEASE SYNTHASE AND SPORULATION NEGATIVE REGULATORY PROTEIN PAI 1.- BACILLUS SUBTILIS. | 3175164 | 1 | ~CAT | TTA~ | 245 | 754 | Reverse |
| 433. | PUTRESCINE TRANSPORT ATP-BINDING PROTEIN POTG.- ESCHERICHIA COLI. | 3175172 | 1 | ATG | TAG | 380 | 844 | Forward |
| 434. | TRIOSEPHOSPHATE ISOMERASE (EC 5.3.1.1) (TIM).- BACILLUS SUBTILIS. | 3175174 | 1 | ~CAT | TTA~ | 270 | 818 | Reverse |
| 435. | Unknown | 3175188 | 1 | ~CAT | TTA~ | 429 | 935 | Reverse |
| 436. | PNUC PROTEIN.- SALMONELLA TYPHIMURIUM. | 3175192 | 1 | ATG | TAG | 111 | 536 | Forward |
| 437. | recF protein- Streptococcus pyogenes | 3175228 | 1 | ~CAT | TTA~ | 144 | 356 | Reverse |
| 438. | 3-DEHYDROQUINATE SYNTHASE (EC 4.6.1.3).- ESCHERICHIA COLI. | 3175240 | 1 | ~CAT | TTA~ | 410 | 1123 | Reverse |
| 439. | Unknown | 3175256 | 1 | ~CAT | TTA~ | 77 | 283 | Reverse |
| 440. | Unknown | 3175262 | 1 | ATG | TAA | 84 | 377 | Forward |
| 441. | Unknown | 3175266 | 1 | ~CAT | TTA~ | 50 | 481 | Reverse |
| 442. | Unknown | 3175288 | 1 | ATG | TGA | 430 | 522 | Forward |
| 443. | NAD-DEPENDENT METHANOL DEHYDROGENASE (EC 1.1.1.244) (MEDH).- BACILLUS METHANOLICUS. | 3175298 | 1 | ~CAT | TTA~ | 440 | 658 | Reverse |

TABLE 1-continued

| SEQ ID NO: | IDENTITY | Assembly ID | ORF # | Codon Start | Stop | Position Start | Stop | Direction |
|---|---|---|---|---|---|---|---|---|
| 444. | ATP SYNTHASE ALPHA CHAIN (EC 3.6.1.34).- ENTEROCOCCUS FAECALIS (STREPTOCOCCUS FAECALIS). | 3175306 | 1 | ATG | TGA | 478 | 639 | Forward |
| 445. | ANTHRANILATE SYNTHASE COMPONENT II (EC 4.1.3.27) (GLUTAMINE AMIDO-TRANSFERASE).- LACTOCOCCUS LACTIS (SUBSP. LACTIS) (STREPTOCOCCUS LACTIS). | 3175310 | 1 | ATG | TGA | 117 | 683 | Forward |
| 446. | Unknown | 3175322 | 1 | CTG | TAA | 3 | 413 | Forward |
| 447. | ALANYL-TRNA SYNTHETASE (EC 6.1.1.7) (ALANINE--TRNA LIGASE) (ALARS).- ESCHERICHIA COLI. | 3175332 | 1 | ATG | TAA | 432 | 1250 | Forward |
| 448. | dihydrolipoamide dehydrogenase (EC 1.8.1.4)- Pelobacter carbinolicus | 3175356 | 1 | ~CAT | TTA~ | 486 | 1241 | Reverse |
| 449. | Unknown | 3175366 | 1 | CTG | TGA | 1 | 405 | Forward |
| 450. | Unknown | 3175380 | 1 | ~CAT | TCA~ | 168 | 413 | Reverse |
| 451. | ASPARTATE--AMMONIA LIGASE (EC 6.3.1.1) (ASPARAGINE SYNTHETASE) ESCHERICHIA COLI. | 3175380 | 2 | ~CAT | TTA~ | 422 | 913 | Reverse |
| 452. | aldose 1-epimerase precursor (mutarotase) (mro) homolog- Haemophilus influenzae (strain Rd KW20) | 3175406 | 1 | ~CAA | TTA~ | 6 | 701 | Reverse |
| 453. | DIHYDROOROTATE DEHYDROGENASE (EC 1.3.3.1) (DIHYDROOROTATE OXIDASE) (DHODEHASE).- BACILLUS SUBTILIS. | 3175442 | 1 | ATG | TAA | 198 | 551 | Forward |
| 454. | SINGLE-STRAND BINDING PROTEIN (SSB) (HELIX-DESTABILIZING PROTEIN).- BACILLUS SUBTILIS. | 3175444 | 1 | ~CAT | TCA~ | 12 | 242 | Reverse |
| 455. | 3-OXOACYL-[ACYL-CARRIER PROTEIN] REDUCTASE (EC 1.1.1.100) (3-KETOACYL-ACYL CARRIER PROTEIN REDUCTASE). ESCHERICHIA COLI. | 3175444 | 2 | ~CAT | TTA~ | 319 | 717 | Reverse |
| 456. | Unknown | 3175446 | 1 | ~CAT | TCA~ | 432 | 971 | Reverse |
| 457. | Unknown | 3175450 | 1 | ATG | TAG | 75 | 584 | Forward |
| 458. | LPLB PROTEIN.- BACILLUS SUBTILIS. | 3175478 | 1 | ATG | TAA | 63 | 278 | Forward |
| 459. | Unknown | 3175494 | 1 | ATG | TGA | 514 | 759 | Forward |
| 460. | Unknown | 3175500 | 1 | ATG | TGA | 310 | 537 | Forward |
| 461. | 30S RIBOSOMAL PROTEIN S9 (BS10).- BACILLUS STEAROTHER- MOPHILUS. | 3175504 | 1 | ~CAT | TTA~ | 537 | 866 | Reverse |
| 462. | AMINO ACID PERMEASE ROCE.- BACILLUS SUBTILIS. | 3175512 | 1 | ATG | TAA | 319 | 816 | Forward |
| 463. | ARGININE HYDROXIMATE RESISTANCE PROTEIN.- BACILLUS SUBTILIS. | 3175526 | 1 | ~CAT | CTA~ | 1 | 381 | Reverse |
| 464. | Unknown | 3175532 | 1 | ATG | TAA | 309 | 644 | Forward |
| 465. | P115 protein- Mycoplasma hyorhinis (SGC3) | 3175536 | 1 | ATG | TGA | 132 | 899 | Forward |
| 466. | Unknown | 3175538 | 1 | ATG | TGA | 427 | 507 | Forward |
| 467. | Unknown | 3175552 | 1 | ATG | TAA | 76 | 381 | Forward |
| 468. | Unknown | 3175556 | 1 | ~CAT | TTA~ | 175 | 597 | Reverse |
| 469. | Unknown | 3175564 | 1 | ATG | TAA | 3 | 164 | Forward |
| 470. | 30S RIBOSOMAL PROTEIN S17 (BS16).- BACILLUS SUBTILIS. | 3175566 | 1 | ~CAT | TTA~ | 388 | 648 | Reverse |
| 471. | Unknown | 3175600 | 1 | ~CAT | CTA~ | 366 | 626 | Reverse |
| 472. | LICD PROTEIN.- HAEMOPHILUS INFLUENZAE. | 3175612 | 1 | ATG | TGA | 134 | 535 | Forward |
| 473. | DNA POLYMERASE III, ALPHA CHAIN (EC 2.7.7.7).- BACILLUS SUBTILIS. | 3175632 | 1 | TTG | TAA | 3 | 506 | Forward |
| 474. | ASPARTATE CARBAMOYL TRANSFERASE (EC 2.1.3.2) (ATCASE).- BACILLUS SUBTILIS. | 3175638 | 1 | ATG | TGA | 269 | 526 | Forward |
| 475. | SPO0B-ASSOCIATED GTP-BINDING PROTEIN.- BACILLUS SUBTILIS. | 3175640 | 1 | ~CAT | TCA~ | 21 | 476 | Reverse |
| 476. | URACIL PERMEASE.- BACILLUS CALDOLYTICUS. | 3175644 | 1 | ~CAT | TTA~ | 42 | 287 | Reverse |
| 477. | Unknown | 3175650 | 1 | ATG | TAA | 158 | 676 | Forward |
| 478. | DIHYDRODIPICOLINATE SYNTHASE (EC 4.2.1.52) (DHDPS).- BACILLUS SUBTILIS. | 3175652 | 1 | ~CAT | TTA~ | 179 | 514 | Reverse |
| 479. | Unknown | 3175664 | 1 | ATG | TGA | 596 | 979 | Forward |
| 480. | DIACYLGLYCEROL KINASE (EC 2.7.1.107) (DAGK) (DIGLYCERIDE KINASE) (DGK).- STREPTOCOCCUS MUTANS. | 3175670 | 1 | ~CAT | TTA~ | 77 | 367 | Reverse |
| 481. | DnaK protein- Lactococcus lactis | 3175688 | 1 | ~CAA | TTA~ | 170 | 1093 | Reverse |
| 482. | serine transporter (sdaC) homolog- Haemophilus influenzae (strain Rd KW20) | 3175698 | 1 | ATG | TGA | 289 | 528 | Forward |

TABLE 1-continued

| SEQ ID NO: | IDENTITY | Assembly ID | ORF # | Codon Start | Stop | Position Start | Stop | Direction |
|---|---|---|---|---|---|---|---|---|
| 483. | phage infection protein precursor- *Lactococcus lactis* subsp. *lactis* (strain C2) | 3175726 | 1 | ~CAG | TTA~ | 152 | 892 | Reverse |
| 484. | SCU19250 NCBI gi: 625076- *Streptomyces coelicolor*. | 3175744 | 1 | ATG | TGA | 3 | 431 | Forward |
| 485. | livH protein- *Escherichia coli* | 3175754 | 1 | ATG | TAA | 3 | 677 | Forward |
| 486. | URACIL PERMEASE.- *BACILLUS SUBTILIS*. | 3175758 | 1 | ~CAT | TTA~ | 49 | 555 | Reverse |
| 487. | Unknown | 3175770 | 1 | ATG | TAG | 28 | 171 | Forward |
| 488. | Unknown | 3175770 | 2 | ATG | TAA | 141 | 311 | Forward |
| 489. | Unknown | 3175774 | 1 | CTG | TAA | 1 | 408 | Forward |
| 490. | METHIONYL-TRNA SYNTHETASE (EC 6.1.1.10) (METHIONINE--TRNA LIGASE) (METRS).- *BACILLUS SUBTILIS*. | 3175778 | 1 | ATG | TGA | 384 | 767 | Forward |
| 491. | STAGE III SPORULATION PROTEIN E.- *BACILLUS SUBTILIS*. | 3175786 | 1 | ~CAT | TTA~ | 8 | 202 | Reverse |
| 492. | L-FUCOSE ISOMERASE (EC 5.3.1.-).- *ESCHERICHIA COLI*. | 3175790 | 1 | ATG | TGA | 328 | 534 | Forward |
| 493. | L-FUCOSE ISOMERASE (EC 5.3.1.-).- *ESCHERICHIA COLI*. | 3175790 | 2 | ATG | TGA | 440 | 784 | Forward |
| 494. | 50S RIBOSOMAL PROTEIN L15.- *BACILLUS STEAROTHERMOPHILUS*. | 3175792 | 1 | ATG | TAA | 230 | 670 | Forward |
| 495. | Unknown | 3175794 | 1 | ~CAT | TCA~ | 190 | 381 | Reverse |
| 496. | COME OPERON PROTEIN 2.- *BACILLUS SUBTILIS*. | 3175800 | 1 | ~CAT | TTA~ | 182 | 649 | Reverse |
| 497. | Unknown | 3175804 | 1 | CTG | TAA | 1 | 567 | Forward |
| 498. | Unknown | 3175806 | 1 | ~CAT | TCA~ | 283 | 657 | Reverse |
| 499. | Unknown | 3175812 | 1 | ~CAT | TCA~ | 78 | 596 | Reverse |
| 500. | FOLYLPOLYGLUTAMATE SYNTHASE (EC 6.3.2.17) (FOLYLPOLY-GAMMA-GLUTAMATE SYNTHETASE) (FPGS).- *BACILLUS SUBTILIS*. | 3175836 | 1 | ATG | TAG | 60 | 590 | Forward |
| 501. | Unknown | 3175848 | 1 | ~CAT | TCA~ | 72 | 620 | Reverse |
| 502. | PHOSPHOSERINE PHOSPHATASE (EC 3.1.3.3) (PSP) (O-PHOSPHOSERINE PHOSPHOHYDROLASE)- *ESCHERICHIA COLI*. | 3175854 | 1 | ATG | TAA | 347 | 841 | Forward |
| 503. | Unknown | 3175866 | 1 | ~CAT | CTA~ | 175 | 534 | Reverse |
| 504. | AEROBIC GLYCEROL-3-PHOSPHATE DEHYDROGENASE (EC 1.1.99.5).- *BACILLUS SUBTILIS*. | 3175882 | 1 | ~CAA | TTA~ | 254 | 520 | Reverse |
| 505. | Unknown | 3175896 | 1 | ~CAT | TTA~ | 64 | 636 | Reverse |
| 506. | Unknown | 3175916 | 1 | ATG | TGA | 177 | 437 | Forward |
| 507. | DNA-DIRECTED RNA POLYMERASE BETA CHAIN (EC 2.7.7.6) (TRANSCRIPTASE BETA CHAIN).- *BACILLUS SUBTILIS*. | 3175948 | 1 | TTG | TAG | 2 | 187 | Forward |
| 508. | Unknown | 3175960 | 1 | ATG | TGA | 534 | 758 | Forward |
| 509. | DNA topoisomerase (ATP-hydrolyzing) (EC 5.99.1.3) chain B- *Staphylococcus aureus* | 3175984 | 1 | ~CAT | TTA~ | 125 | 604 | Reverse |
| 510. | GLUTAMYL ENDOPEPTIDASE PRECURSOR (EC 3.4.21.19) (GLUTAMATE SPECIFIC ENDOPEPTIDASE) (GSE).- *BACILLUS LICHENIFORMIS*. | 3175998 | 1 | ~CAT | TCA~ | 43 | 540 | Reverse |
| 511. | 6-phosphofructokinase (EC 2.7.1.11)- *Lactococcus lactis* | 3176002 | 1 | ATG | TAA | 662 | 829 | Forward |
| 512. | Unknown | 3176010 | 1 | CTG | TAA | 1 | 546 | Forward |
| 513. | ASPARTYL-TRNA SYNTHETASE (EC 6.1.1.12) (ASPARTATE--TRNA LIGASE) (ASPRS).- *THERMUS AQUATICUS* (SUBSP. *THERMOPHILUS*. | 3176030 | 1 | ~CAT | TCA~ | 140 | 625 | Reverse |
| 514. | Unknown | 3176046 | 1 | ~CAT | TTA~ | 242 | 454 | Reverse |
| 515. | GLYCOGEN BIOSYNTHESIS PROTEIN GLGD.- *BACILLUS SUBTILIS*. | 3176048 | 1 | ATG | TAG | 411 | 704 | Forward |
| 516. | S71704 NCBI gi: 560722- *Legionella pneumophila* Philadelphia-1. | 3176050 | 1 | ATG | TGA | 205 | 492 | Forward |
| 517. | PFS PROTEIN (P46).- *ESCHERICHIA COLI*. | 3176076 | 1 | ~CAT | TCA~ | 40 | 234 | Reverse |
| 518. | Unknown | 3176082 | 1 | ATG | TAA | 48 | 491 | Forward |
| 519. | SGHRDT NCBI gi: 510450- *Streptomyces griseus*. | 3176086 | 1 | ~CAG | TCA~ | 23 | 535 | Reverse |
| 520. | Unknown | 3176108 | 1 | ~CAT | TTA~ | 4 | 501 | Reverse |
| 521. | trsB protein- *Yersinia enterocolitica* | 3176112 | 1 | ATG | TGA | 127 | 408 | Forward |
| 522. | Unknown | 3176116 | 1 | ATG | TAA | 198 | 515 | Forward |
| 523. | Unknown | 3176120 | 1 | ~CAA | TTA~ | 295 | 729 | Reverse |
| 524. | SIGNAL PEPTIDASE I (EC 3.4.21.89) (SPASE I) (LEADER PEPTIDASE I).- *BACILLUS CALDOLYTICUS*. | 3176124 | 1 | ~CAT | TCA~ | 298 | 570 | Reverse |

TABLE 1-continued

| SEQ ID NO: | IDENTITY | Assembly ID | ORF # | Codon Start | Stop | Position Start | Stop | Direction |
|---|---|---|---|---|---|---|---|---|
| 525. | ligoendopeptidase F- *Lactococcus lactis* | 3176132 | 1 | ~CAT | TCA~ | 51 | 380 | Reverse |
| 526. | Unknown | 3176134 | 1 | ~CAT | TTA~ | 299 | 436 | Reverse |
| 527. | Unknown | 3176136 | 1 | CTG | TAA | 1 | 273 | Forward |
| 528. | Unknown | 3176152 | 1 | ~CAT | TCA~ | 260 | 688 | Reverse |
| 529. | Unknown | 3176158 | 1 | ATG | TGA | 273 | 386 | Forward |
| 530. | purine-nucleoside phosphorylase (EC 2.4.2.1)- *Bacillus subtilis* (fragment) | 3176172 | 1 | ~CAT | TTA~ | 89 | 331 | Reverse |
| 531. | Unknown | 3176178 | 1 | ~CAA | CTA~ | 101 | 532 | Reverse |
| 532. | PTS SYSTEM, LACTOSE-SPECIFIC IIBC COMPONENT (EIIBC-LAC) LACTOSE-PERMEASE IIBC COMPONENT) PHOSPHOTRANSFERASE ENZYME II, BC COMPONENT) (EC 2.7.1.69) (EII-LAC).- *LACTOCOCCUS LACTIS* (SUBSP. *LACTIS*). | 3176182 | 1 | ~CAT | TCA~ | 43 | 246 | Reverse |
| 533. | Unknown | 3176184 | 1 | ATG | TGA | 61 | 336 | Forward |
| 534. | Unknown | 3176188 | 1 | ATG | TAG | 42 | 248 | Forward |
| 535. | Unknown | 3176208 | 1 | ATG | TAA | 41 | 238 | Forward |
| 536. | Unknown | 3176216 | 1 | ~CAT | TTA~ | 135 | 335 | Reverse |
| 537. | Unknown | 3176248 | 1 | ~CAT | TTA~ | 141 | 386 | Reverse |
| 538. | Unknown | 3176260 | 1 | ATG | TGA | 158 | 343 | Forward |
| 539. | Unknown | 3176272 | 1 | ~CAT | TTA~ | 331 | 465 | Reverse |
| 540. | REGULATORY PROTEIN MTRR.- *NEISSERIA GONORRHOEAE*. | 3176280 | 1 | ATG | TAA | 287 | 502 | Forward |
| 541. | Unknown | 3176288 | 1 | ~CAA | TCA~ | 5 | 520 | Reverse |
| 542. | Unknown | 3176304 | 1 | ~CAT | TCA~ | 41 | 433 | Reverse |
| 543. | Unknown | 3176330 | 1 | CTG | TGA | 2 | 298 | Forward |
| 544. | Unknown | 3176330 | 2 | ATG | TAG | 271 | 381 | Forward |
| 545. | 6-PHOSPHO-BETA-GLUCOSIDASE (EC 3.2.1.86).- *ESCHERICHIA COLI*. | 3176338 | 1 | ~CAT | TCA~ | 5 | 130 | Reverse |
| 546. | Unknown | 3176394 | 1 | ~CAT | TTA~ | 17 | 223 | Reverse |
| 547. | Unknown | 3176398 | 1 | ~CAT | TTA~ | 41 | 310 | Reverse |
| 548. | Unknown | 3176420 | 1 | ~CAA | TTA~ | 382 | 678 | Reverse |
| 549. | possible acid phosphatase | 3176446 | 1 | ATG | TGA | 113 | 475 | Forward |
| 550. | Unknown | 3176480 | 1 | ATG | TAG | 151 | 417 | Forward |
| 551. | Unknown | 3176542 | 1 | ATG | TAA | 129 | 446 | Forward |
| 552. | Unknown | 3176560 | 1 | ~CAT | TTA~ | 102 | 374 | Reverse |

Table 2 shows the correlation between the SEQ ID NO of each DNA sequence of the invention with the SEQ ID NO(S) of polypeptide or polypeptides that its open reading frame(s) codes. For example, the DNA of SEQ ID NO:1 encodes one polypeptide, that of SEQ ID NO:24. Whereas, the DNA of SEQ ID NO:2 encodes two polypeptides, the polypeptides of SEQ ID NO:286 and SEQ ID NO:287.

TABLE 2

| DNA | Protein (open reading frame) |
|---|---|
| 1 | 263 |
| 2 | 264 |
| 3 | 265 |
| 4 | 266 |
| 5 | 267 |
| 6 | 268 |
| 7 | 269 |
| 8 | 270 |
| 9 | 271 |
| 10 | 272 |
| 11 | 273 |
| 12 | 274 |
| 13 | 275 |
| 14 | 276 |
| 15 | 277 |
| 16 | 278 |
| 17 | 279 |
| 18 | 280 |
| 19 | 281 |
| 20 | 282 |
| 21 | 283 |
| 22 | 284 |

TABLE 2-continued

| DNA | Protein (open reading frame) |
|---|---|
| 23 | 285 |
| 24 | 286, 287 |
| 25 | 288 |
| 26 | 289 |
| 27 | 290 |
| 28 | 291 |
| 29 | 292 |
| 30 | 293 |
| 31 | 294 |
| 32 | 295 |
| 33 | 296 |
| 34 | 297 |
| 35 | 298 |
| 36 | 299 |
| 37 | 300 |
| 38 | 301 |
| 39 | 302 |
| 40 | 303 |
| 41 | 304 |
| 42 | 305, 306 |
| 43 | 307 |
| 44 | 308, 309 |
| 45 | 310 |
| 46 | 311, 312 |
| 47 | 313 |
| 48 | 314 |
| 49 | 315, 316 |
| 50 | 317, 318 |
| 51 | 319, 320 |
| 52 | 321, 322 |
| 53 | 323 |

TABLE 2-continued

| DNA | Protein (open reading frame) |
|---|---|
| 54 | 324 |
| 55 | 325 |
| 56 | 326, 327 |
| 57 | 328 |
| 58 | 329, 330 |
| 59 | 331 |
| 60 | 332 |
| 61 | 333, 334 |
| 62 | 335, 336 |
| 63 | 337 |
| 64 | 338 |
| 65 | 339 |
| 66 | 340 |
| 67 | 341 |
| 68 | 342 |
| 69 | 343 |
| 70 | 344 |
| 71 | 345 |
| 72 | 346 |
| 73 | 347 |
| 74 | 348, 349 |
| 75 | 350 |
| 76 | 351 |
| 77 | 352 |
| 78 | 353, 354 |
| 79 | 355, 356 |
| 80 | 357 |
| 81 | 358 |
| 82 | 359, 360 |
| 83 | 361 |
| 84 | 362 |
| 85 | 363 |
| 86 | 364, 365 |
| 87 | 366 |
| 88 | 367 |
| 89 | 368 |
| 90 | 369 |
| 91 | 370 |
| 92 | 371 |
| 93 | 372 |
| 94 | 373 |
| 95 | 374 |
| 96 | 375 |
| 97 | 376 |
| 98 | 377 |
| 99 | 378, 379 |
| 100 | 380 |
| 101 | 381 |
| 102 | 382, 383 |
| 103 | 384 |
| 104 | 385 |
| 105 | 386 |
| 106 | 387 |
| 107 | 388 |
| 108 | 389 |
| 109 | 390 |
| 110 | 391 |
| 111 | 392 |
| 112 | 393 |
| 113 | 394 |
| 114 | 395 |
| 115 | 396 |
| 116 | 397 |
| 117 | 398 |
| 118 | 399 |
| 119 | 400 |
| 120 | 401 |
| 121 | 402, 403 |
| 122 | 404 |
| 123 | 405 |
| 124 | 406 |
| 125 | 407 |
| 126 | 408 |
| 127 | 409 |
| 128 | 410, 411 |
| 129 | 412 |
| 130 | 413 |
| 131 | 414 |
| 132 | 415 |
| 133 | 416 |
| 134 | 417, 418 |
| 135 | 419 |
| 136 | 420 |
| 137 | 421, 422 |
| 138 | 423 |
| 139 | 424 |
| 140 | 425 |
| 141 | 426 |
| 142 | 427 |
| 143 | 428 |
| 144 | 429 |
| 145 | 430 |
| 146 | 431 |
| 147 | 432 |
| 148 | 433 |
| 149 | 434 |
| 150 | 435 |
| 151 | 436 |
| 152 | 437 |
| 153 | 438 |
| 154 | 439 |
| 155 | 440 |
| 156 | 441 |
| 157 | 442 |
| 158 | 443 |
| 159 | 444 |
| 160 | 445 |
| 161 | 446 |
| 162 | 447 |
| 163 | 448 |
| 164 | 449 |
| 165 | 450, 451 |
| 166 | 452 |
| 167 | 453 |
| 168 | 454, 455 |
| 169 | 456 |
| 170 | 457 |
| 171 | 458 |
| 172 | 459 |
| 173 | 460 |
| 174 | 461 |
| 175 | 462 |
| 176 | 463 |
| 177 | 464 |
| 178 | 465 |
| 179 | 466 |
| 180 | 467 |
| 181 | 468 |
| 182 | 469 |
| 183 | 470 |
| 184 | 471 |
| 185 | 472 |
| 186 | 473 |
| 187 | 474 |
| 188 | 475 |
| 189 | 476 |
| 190 | 477 |
| 191 | 478 |
| 192 | 479 |
| 193 | 480 |
| 194 | 481 |
| 195 | 482 |
| 196 | 483 |
| 197 | 484 |
| 198 | 485 |
| 199 | 486 |
| 200 | 487, 488 |
| 201 | 489 |
| 202 | 490 |
| 203 | 491 |
| 204 | 492, 493 |
| 205 | 494 |
| 206 | 495 |
| 207 | 496 |

TABLE 2-continued

| DNA | Protein (open reading frame) |
|---|---|
| 208 | 497 |
| 209 | 498 |
| 210 | 499 |
| 211 | 500 |
| 212 | 501 |
| 213 | 502 |
| 214 | 503 |
| 215 | 504 |
| 216 | 505 |
| 217 | 506 |
| 218 | 507 |
| 219 | 508 |
| 220 | 509 |
| 221 | 510 |
| 222 | 511 |
| 223 | 512 |
| 224 | 513 |
| 225 | 514 |
| 226 | 515 |
| 227 | 516 |
| 228 | 517 |
| 229 | 518 |
| 230 | 519 |
| 231 | 520 |
| 232 | 521 |
| 233 | 522 |
| 234 | 523 |
| 235 | 524 |
| 236 | 525 |
| 237 | 526 |
| 238 | 527 |
| 239 | 528 |
| 240 | 529 |
| 241 | 530 |
| 242 | 531 |
| 243 | 532 |
| 244 | 533 |
| 245 | 534 |
| 246 | 535 |
| 247 | 536 |
| 248 | 537 |
| 249 | 538 |
| 250 | 539 |
| 251 | 540 |
| 252 | 541 |
| 253 | 542 |
| 254 | 543, 544 |
| 255 | 545 |
| 256 | 546 |
| 257 | 547 |
| 258 | 548 |
| 259 | 549 |
| 260 | 550 |
| 261 | 551 |
| 262 | 552 |

EXAMPLES

In order to facilitate understanding of the following example certain frequently occurring methods and/or terms will be described.

"Plasmids" are designated by a lower case p preceded and/or followed by capital letters and/or numbers. The starting plasmids herein are either commercially available, publicly available on an unrestricted basis, or can be constructed from available plasmids in accord with published procedures. In addition, equivalent plasmids to those described are known in the art and will be apparent to the ordinarily skilled artisan.

"Digestion" of DNA refers to catalytic cleavage of the DNA with a restriction enzyme that acts only at certain sequences in the DNA. The various restriction enzymes used herein are commercially available and their reaction conditions, cofactors and other requirements were used as would be known to the ordinarily skilled artisan. For analytical purposes, typically 1 µg of plasmid or DNA fragment is used with about 2 units of enzyme in about 20 µl of buffer solution. For the purpose of isolating DNA fragments for plasmid construction, typically 5 to 50 µg of DNA are digested with 20 to 250 units of enzyme in a larger volume. Appropriate buffers and substrate amounts for particular restriction enzymes are specified by the manufacturer. Incubation times of about 1 hour at 37° C. are ordinarily used, but may vary in accordance with the supplier's instructions. After digestion the reaction is electrophoresed directly on a polyacrylamide gel to isolate the desired fragment.

Size separation of the cleaved fragments is performed using 8 percent polyacrylamide gel described by Goeddel, D. et al., (1980) Nucleic Acids Res., 8:4057.

"Oligonucleotides" refers to either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide will ligate to a fragment that has not been dephosphorylated.

"Ligation" refers to the process of forming phosphodiester bonds between two double stranded nucleic acid fragments (Maniatis, T., et al., supra., p. 146). Unless otherwise provided, ligation may be accomplished using known buffers and conditions with 10 units to T4 DNA ligase ("ligase") per 0.5 µg of approximately equimolar amounts of the DNA fragments to be ligated.

Example 1

Isolation of DNA Coding for a Virulence Gene in *Streptococcus pneumoniae*

As mentioned above each of the DNAs disclosed herein by virtue of the fact that it includes an intact open reading frame is useful to a greater or lesser extent as a screen for identifying antimicrobial compounds. A useful approach for selecting the preferred DNA sequences for screen development is evaluation by insertion-duplication mutagenesis. This system disclosed by Morrison et al., *J. Bacteriol.* 159:870 (1984), is applied as follows.

Briefly, random fragments of *Streptococcus pneumoniae*, strain 0100993 DNA are generated enzymatically (by restriction endonuclease digestion) or physically (by sonication based shearing) followed by gel fractionation and end repair employing T4 DNA polymerase. It is preferred that the DNA fragments so produced are in the range of 200–400 base pairs, a size sufficient to ensure homologous recombination and to insure a representative library in *E. coli*. The fragments are then inserted into appropriately tagged plasmids as described in Hensel et al., *Science* 269: 400–403 (1995). Although a number of plasmids can be used for this purpose, a particularly useful plasmid is pJDC9 described by Pearce et al., *Mol. Microbiol.* 9:1037 (1993) which carries the erm gene facilitating erythromycin selection in either *E. coli* or *S. pneumoniae* previously modified by incorporation of DNA sequence tags into one of the polylinker cloning sites. The tagged plasmids are introduced into the appropriate *S. pneumoniae* strain selected, inter alia, on the basis of serotype and virulence in a murine model of pneumococcal pneumonia It is appreciated that a seventeen amino acid competence factor exists (Havastein et al., *Proc. Nat'l. Acad. Sci., USA* 92:1114–44 (1995)) and may be usefully employed in this protocol to increase the transformation frequencies. A proportion of transformants are analysed to verify homologous integration and as a check on stability. Unwanted levels of reversion are minimized because the duplicated regions will be short (200–400 bp), however if significant reversion rates are encountered they may be modulated by maintaining antibiotic selection during the growth of the transformants in culture and/or during growth in the animal.

The *S. pneumoniae* transformants are pooled for inoculation into mice, eg., Swiss and/or C57B1/6. Preliminary experiments are conducted to establish the optimum complexity of the pools and level of inoculum. A particularly useful model has been described by Veber et al. (*J. Antimicrobiol. Chemother.* 32:432 (1993) in which $10^5$ cfu inocula sizes are introduced by mouth to the trachea. Strain differences are observed with respect to onset of disease e.g.,3–4 days for Swiss mice and 8–10 days for C57B1/16. Infection yields in the lungs approach $10^8$ cfu/lung. IP administration is also possible when genes mediating blood stream infection are evaluated. Following optimization of parameters of the infection model, the mutant bank normally comprising several thousand strains is subjected to the virulence test. Mutants with attenuated virulence are identified by hybridization analysis using the labelled tags from the "input" and "recovered" pools as probes as described in Hensel et al., *Science* 269: 400–403(1995). *S. pneumoniae* DNA is colony blotted or dot blotted, DNA flanking the integrated plasmid is cloned by plasmid rescue in *E. coli* (Morrison et al., *J. Bacteriol.* 159:870 (1984)) and sequenced. Following sequencing, the DNA is compared to the nucleotide sequences given herein and the appropriate ORF is identified and function confirmed for example by knock-out studies. Expression vectors providing the selected protein are prepared and the protein is configured in an appropriate screen for the identification of anti-microbial agents. Alternatively, genomic DNA libraries are probed with restriction fragments flanking the integrated plasmid to isolate full-length cloned virulence genes whose function can be confirmed by "knock-out" studies or other methods, which are then expressed and incorporated into a screen as described above.

SEQUENCE LISTING (552 sequences)

SEQ ID NO: 1 - DNA, 805 bp; single-stranded, linear
ctanacaaaccagataaggaccaagagcttaaagctgaaattcaatccatttttatcgaacacaagggaaattatgcttatcgctgtattcatttagaactaagaaattcgtgcttatctggtaaatcataaaagagttcaaggcttgatgaaagtactcaatttacaagctaaaatgcgacagaaacgaaaataaaggagacgttggtaagaaggcagagaatctcattcaaggccaatttgaaggctctaaaacaatggaaaagtgctacacagatgtgacagaatttgccattccagcaagtactcaaaagctttacttatcaccagttttagatggctttaatagcgaaattatcgcctataatctttcaacttcacccaacttagaacaagtacaaacaatgttggaacaggcattcacagagaagcactacgagaatacgattctccatagtgaccaaggctggcaataccaacacgattcttatcatcggttcctagagagtaagggaattcaagcatccatgtcacgcaagggaaacagccaagataacggtatgatggaatctttctttgggattctgaaatcggaaatgttttacggttatgagaagtcgtttcagtcgcttaagcaattggaacaagccattatagactatattgattactacaacaataagagaattaaggtaaaactaaaaggacttagccctgtgcaatacagaactaaatccttcggataaattaattgtctaacttttggggggcagtacatttttggtatatataaaatttgtaggag

SEQ ID NO: 2 - DNA, 764 bp; single-stranded, linear
ttcgatctggttaccgttgctgatagtaatgaaatacctactaacaattcacctaaagcatcaatttgaaaagtttctactagaatatgaaataaaggattaatgggtcttgtcaggtatttatcaaattcgcccttacgaaccaggcgttgccctagagcccataaattatcaaaaaagagatgatcaattcccttgggaattagggaaaagccatagataaaggcaatctgctgaaaactccacccatcaagtgatgggatgttttgaaatataatattaagaaataacaggtttaacccttgcgttaaaaaacgcctaaaacgccaacaacgaagtcaaccttatactccacaatttgcttgaggtattgtctgataaaaatcaagtgcatacgttgatatttcttcatactaacctccttgaatagtaatgtgggactgtacacgtttccaaataatttgggacaaagcaatcataacaagcaaccaaaataattgtagcaagacagcctgaagaatctgactggcatcgtattttccaacaatgatcataactggagtataaatcaaggatgaaaaaggcaaaaggagaggatatctgagacaacctttggagaggatgccaagggaatcaaactccccgacattaaagccactatggaagtcttaagtaggttggaaccccaaagatttttaaacacaaaggctgtaaatcccaagcaaatattaaagaaaaagttaatcagataggcgagcgttaag

SEQ ID NO: 3 - DNA, 1133 bp; single-stranded, linear
ctaagacaggagtccgaatgtcaatacggatttcagaacgttcatgattgatcatgagacctgcgacattaaaggataggtgaccagaaggttcatctgctatatcaccaaagatttgtcttcctgtgccgtcttgacctgcttgtgttgcaagaaaactgagagcagggtgttcttggagaggagcaagaatggtagctagtcggatgacagcattgataccttgactagcatccttagcatgctttggcactccgagaaccgttacggtttgttcagtggattggtaatcataaccagcttctttgagaccgttacaaacctgttcatagaggggaccttggtagttggccttgtctggtacaacgttaaaggcgcctcctacttcaagctctagttgatccgatccagagccataaagtttgacctgtagaagccctttttcagcataggtcagaagaaaagatgagtcaggtgcnaagcccatactggcctgttcttcgatggtattgtagcgtgccatgcagcgccagagggtttcctcatcggtaccaaagataaagcgtacgcgctttttgaactgaataccttggtccagcaagctttttactgcatagagagctgcgagcggagggcctttatcatcttggacaccacgtccgatacccagccgtctttgatagttgcttcaaatggcggtgtctgccaatctgcttcatcacctgatggaacaacatccaaatgacagagaatggccagaagctctgctccctgaccgatttctgcatatccgtaataacctttagggtcaagataggtagtgaaacctatgtctcgacaaatctctaaagttttttctaggacatcttggattgcttgtccaaaaggtgttccattttctccttcattgagtactgaaggataggaaatcaaggtttttaatgatataagaaattcatctttaacttgatttgttatatctattttcatggaatcacctcactcaccattttataggaatggaaggaaggttccaaggagaagaagggcgatggtcactacaataatagcgactacgagtttgcccatgaatttccaccaagtaccaatgttgatacgtccaagtgcaagag

SEQ ID NO: 4 - DNA, 1071 bp; single-stranded, linear
tgataagtatgagactcgaagcattgaacattaaacttccagatttcagatatatggtggaccttcaaatcatcatacttattttggagataaaaaacgatatttacaagcaattaagaattgagcaagagctatttacagtagcttaatgaaaggaaagtatgtcaattacatcatttgtaaaaagaattcaagatatcactcgaaacgatgctggtgttaatggtgatgctcaacgtattgagcaaatgtcttggttattattcttaaaaatttatgatagccgtgaaatggttggggaattaggaagaaggacggagtatggagtcaattattcccaggaggaattaaaatggcggaaattggggctcatgctcaaaatggggaacgggtattgacaggcgatgaattaattgattttgtcaataacaagttattcaaagagttgaaaggagcttgaaataacttcaaatatgcctattcgaaaaacgattattaaatcagcttttgaagatgcgaacaactatatgaaaaatggcgtcttgttacgccaagtcatcaatgttattgatgaagttgatttcaatagccctgaagatcgtcattcgtttaatgatatttacgaaaaaattcttaaagatattcaaaatgctgggaactcaggagaattttatacgccacgtgcagcgactgattttattgccgaagttcttgacccaaaacttggagaatcaatggcagaccttgcttgcggaacaggaggcttcttgacttcgactctgaaccgtttaagtagtcaacgtaaaactagtgaagataccaaaaaatataatacagctgtttttggtattgaaaagaaagcatttcctcatcttttagcagttacaaatctgtttcttcacgaaattgatgaccctaaaattgttcatggaaatactttggagaaaaatgttcgtgaatatacggatgatgaaaaatttgacattattatgatgaatccaccttttggagggtcagaattagaaacaataaaaaataactttccagcagaattacggagttctgaaacag

SEQ ID NO: 5 - DNA, 1450 bp; single-stranded, linear
ctaggatagaccgctttttagcatttatctaagcattccagagtacatgtatcttgcatgtgctctttcttttggggttgaaacgataggagaaggaaatgttagaattgcttaaatcaatcgatgcttttgcttggggaccgcccctcttgatttattggtcggaacagggatttacctaaccatgcggctaggactcttgcaggttttgcgtctgcccaaggcctttcagcttatttttatccaggataagggacatggtgatgtatccagttttacagcttcttgtgtaacaggcccttgggcattcaaactggttgggaaacagggaaatatccattagggagttggcgacggctatcaaggttggtggaccaggagctctattttggatgtggatggcggctttctttggaatggctaccaagtatgcggaaggactcttggccatcaaataccgcaccaaggacgaccatggtgcagtagcgggaggtcccatgcattatatccttctagggatgggagaaaagtggcgaccacttgctgttttgtttgcagtagcaggagtattggttgctctcttgggaatcggaaccttcacccaagtcaactcgattacagaatctatccaaaatacaacgacgatttcgccagccatcacagctctcgtcttgtctgtctttgtagcgattgcagtctttggtggactcaagtctatttctaaggtttcaactactgttgttccttttatggccatcatttatatcttaggaactcttacagttattttctttaatatcggaaaaatccctggcacaatcgctttagtctttacctcagcttttagtccccttgctgcggtaggtggatttgctggtgctagcgttcggatggctattcaaaatggtgtggcgcgtggtgtgttttcaaacgaatctggtctgggttctgctcctattgcagctgcagctgccaagacaaatgaaccagtagagcaaggtttgatttccatgacaggaacctttattgataccctcatcatttgtactctaactggtttgaccatcttggtaactggagtttggagtggtgacttgaatggggttgccttgactcagtcagctttctcaacagtcttttcacactttgggcctgccctcttgaccatcttccttgtgctttttgcctttacaacgattctaggttggaactattacggaagaacgctgttttgagttcctctttggggttcgctttatctggctctaccgngtggtttttgtgctcatggtcttgttaggaggatttatcgagttgganatggtctggattatcgcagatatcgttaacgccttgatggctctgccaaantngattgccctcttggtcttgtcgcaagtcgttattgctgaaactaaaaagtattttgacaaataatggaatcacacag

SEQ ID NO: 6 - DNA, 885 bp; single-stranded, linear
ctcatcatctgtcaaaaagcgtttcttagcagtcgtgatatccataaaataatctaatatcacgatttcctcatccgcaaagaaaggaaggctgaccaactccagtgccacatccttgtaaactacttcttgcatatcaaagtaggcaaagttgaggtcagcagaatcatacccaatctgtttcaacacttgactcttcatcacttcaaactgaccctgatctgtccctgtaaataggcgcaggctcggtaaattcgataaagtcaacttctgactttcttcaatggctagcatcgtctctcctttcttcagatttttcgatttaatttagtcaatatagcgcaatttcccacggaaatcttctaagctctcgtagcctttttccaccatgattgctttcagttcattggtaaagcggtcaaaagcactgacgccttctttgtgaagggtcgttcccacctgcaccatacttgctccacagaggatgtgttcaaaggcatctcgaccagtcagaacgccacctgttccgataatttggatttgaggatttaaacgttgataaaaggcgtgaacattggctagagcagtcggtttgatgtattatccaccaattccaccaaaaccattcttaggccgaataacgacagattcgtcttctatatagaggccgtttccgatagagttaacgcagttgacaaacttgagcggatatttgttgaaaatagctgccgcttgatcaaagtgaacaatatcaaaataaggtggcaatttaattccaagaggtttggtgaagtaagcaaacacttctgccaaaatccggtctgttgtctcaaaatcataggcaatctgaggtttacctggaacatttggacaggaaagatttag

SEQ ID NO: 7 - DNA, 774 bp; single-stranded, linear
ctcaaacaagtggtgagattccagaaaaaaaaacgcgaagaaattgcgtcagattatcacaactatctttgaacaaaagatgaataagcatagtattaagtagagaatgaaaaaatattttattggcggtttgggaagcaatgcctatcatagcaaggattttcttcaagaactagattcgcaggtctattttctaaatccatatgaaaagcatcttcgagatgaaacagaattgaaatcatggtttaaaaatgagattgtagaggaagaatctatctgtctgataggtcattctattggaggcgatttagctcgttatttcgcatcggaatttgaagaagtaaagaaactgattcttttggatggtggctatctagatttagataagattttacctttggatacagagttagaggaaactaaaaattatatcaaatctcaaattatttcggacttagatgttcttacttctaaagaaaaatctgaagcaaagcattggtcagaaaatatggagaaagctgtaagacagtcctatcactggaatgttgagtataatagatatgagttggctataaattatgaaaatatagaagcgatactccgcctacggagaaaaatacaagcttttaagagagaagtgggagataccttgtttattagtcctcgctatcctaatgaagctacatggagagaggaagccctaaaagaattgccagactattttgatactattttttagaaactttggccatgagcctttatactcagcaccta

SEQ ID NO: 8 - DNA, 1196 bp; single-stranded, linear
tgctgaacttggcaagatggtagcagttctcaatacgccagtagaggtcattgaagaagcctgtcaaaaagcttctggaacttggagtggttactccagccaactataacacacctgcacaaatcgtcattgctggagaagtggttgcagttgatcgagcggttgaacttttgcaagaagcaggtgccaaacgcttgattcctcttaaggtgtcaggtccctttcacaccgctctccttgagcctgctagccagaaactagctgaaactctagctcaggtaagtttttcagattttacttgtcccctagtcggcaatacagaagctgctgtgatgcaaaaagaggacattgctcagctcttgacgcgtcaggtcaaggaacccgttcgtttctatgaaagtattggggtcatgcaagaagcaggcataagcaactttattcgagattggaccggggaaagtcttgtcaggttttgttaaaaaaattgatcaaactgctcacttagctcatgtggaagatcaagcgagtttagtagcacttttagaaaaatagactaaaataagtagaagttttgaaaggaaaaaaatgaaactagaacataaaaatatctttattacaggttcgagtcgtggaattggtcttgccatcgcccacaagtttgctcaagcaggagccaacattgtcttaaacagtcgtggggcaatctcagaagaattgctcgctgagttttcaaactatggtatcaaggtggttcccatttcaggagatgtatcagattttgcagacgctaagcgtatgattgatcaagctattgcagaactgggttcagtagatgttttggtcaacaatgcagggattacccaagatactcttatgctcaagatgacagaagcagattttgaaaaagtgctcaaggtcaatctgactggtgcctttaatatgacacaatcagtcttgaaaccgatgatgaaagccagagaaggtgctatcattaatatgtctagtgttgttggtttgatggggaatattggtcaagctaactatgctgcttctaaggctggcttgattggctttaccaagtctgtggcacgcgaggtcgctagtcggaatatacgagtcaatgtgattgctccaggaaatgattgagtctgatatgacagctatcttatcagataagattaaggaagctacactag

SEQ ID NO: 9 - DNA, 861 bp; single-stranded, linear
ctgggaaaaccacccttttcaaccttttgaccggtgtttatgaaccaagcgagggaacagtaaccctagatggtcaccttttgaatgggaaatcaccttataagattgcctctttgggacttggacgtactttccaaaatatccgtctttttaaagatttaacagttttagacaatgttttgattgcttttggaaaccatcacaaacagcatgtttttactagtttcttacgcttaccagctttttacaagagtgaaaaagaattaaaggctaaagctttggaattgttgaaaatctttgatttagatggtgatgcagagactcttgctaaaaatctttcctacggacaacaacgtcgtttggaaattgttcgtgcccttgctacggaaccctaaaattctcttcttagatgaaccagcagcaggtatgaacccacaggaaacagccgaattgactgagttaattcgtcgtatcaaagatgagtttaagattacaatcatgttgattgaacacgatatgaatctggtcatggaagtaacagaacgtatctacgtacttgaatatggccgtttaatcgctcaaggaactccagacgaaattaagaccaataaacgcgttatcgaagcttatctaggaggtgaagcctaatgtctatgttaaaagttgaaaatctttctgtgcattacggtatgatccaagcagttcgtgatgtaagctttgaagttaatgaaggagaagttgtttcccttatcggtgccaacggtgcaggtaagacaactattcttcgcaccttgtcaggtttggttcgaccaagttcaggaaagattgaatttttaggtcaagaaatccaaaaaatgccag

SEQ ID NO: 10 - DNA, 582 bp; single-stranded, linear
ctatgagagagaatgaccttctcttgattactgcggaccatggaaatgacccaacgtatgcaggaacggatcacactcgggaatatattccattgttggcctatagccctgcctttaaaggaaatggtctcattccagtaggacattttgcagatatttcagcgactgttgccgataactttggtgtggaaactgctatgattggggaaagtttcttagataaattggtataagatgacgcgctatgctttgctggtgagaggtatcaatgttggtggtaagaataaggtcgtcatggcggagcttcgtcaagaattgacaaacttgggactggaaaaggttgagagctacatcaatagtggcaatattttctttacttcgatagattccaaagcccaattggttgaaaagctagagactttctttgcagtccattatccatttattccagagcttttctttactgagtctagaggactttgaggcggaacttgaaaatctaccagcttggtggagcacagacttggcacgaaaagattttctcttttacactgagggtttggatgtggaccaacgtcatcg

SEQ ID NO: 11 - DNA, 698 bp; single-stranded, linear
ctgattttttacaatacctgcgaaatcttagatttcttgtgcggacatggaagagtcggccaacggacgttgatttgtaccatctgtaatatgaacaaaacctggtacagttgggattccatagcgtgagcggaatgcttgcaaatcattgagttggcttggttcttcactattgatgaagtaaatgtgagctttggtttcagctacgacacctgacaatgtacctgcaaatttacggcagtaagggcaagttttgcgaccgataaagaaggttgcagtttcttttttatcaagagcttcttgcgcacgcacaactgtagtgacttcaaggtctttgatgttatctaaaaattgttccatgagattacctcgctttcattgataagtctagtatgccataaagtttctaaaattgcttagatttgatacgaaaaaaaatgaggttggttggtctcatcttttataggtctttattttacaaatgcattgatttctgcttcgatgttagcaatcttagcttgtgattcttcgttggtttcccctacaactgcaatgtagaacttgatttttggttctgtacctgaagggcgaacggcaatccatgaaccgtcagcaagttgtgtatttcaacacatcacttggaggagttgtcaagtttgtaacagtaccgtcagcaacagtagcagtttgtgccttga

SEQ ID NO: 12 - DNA, 707 bp; single-stranded, linear
tcaagnggattcgtttcggcggagntatgacgacgggaaaaaccttgaaccaatttttgattgagatggatggttttgagggaaatgaagggattattcgtcatcgctgcgacaaaccgttcagatgtacttgatcctgcccttttgcgttccaggaagttttgatagaaaagtattggttggccgtcctgatgttaaaggtcgtgaagcaatcttgaaagttcacgctaagaacaagcctttagcagaagatgttgatttgaaattagtggctcaacaaactccaggctttgttggtgctgatttagagaatgtcttgaatgaagcagctttagttgctgctcgtcgcaataaatcgataattgatgcttcagatattgatgaagcagaagatagagttattgctggaccttctaagaaagataagacagtttcacaaaaagaacgagaattggttgcttaccatgaggcaggacataccattgttggtctagtcttgtcgaatgctcgcgttgtccataaggttacaattgtaccacgcggccgtgcaggcggatacatnattgcacttcctaaagaggatcaaatgcttctatctaaagaagatatgaaagagcaattggctggcttaatgggtggacgtgtagctgaaaaaattatctctaatgtccaaactaccaggagcttcaaacgactttgaacaagcc

SEQ ID NO: 13 - DNA, 571 bp; single-stranded, linear
ctcaatcaattcttcattagtagttgattgatgcagttgactttcgatttgttcactcttgcggtcgattgaacgaagggctgttaggtaaagtctgcattgcgataaagaatttgaaagataaaacgtgaacgcatgaaggtatagaaattacgcaatcgacggttgataaagacatcaaggacaggtagtggttccaaacacgtagtgataatggtttcctcagtgatgataataccaagcgggatggttacctagtaggtgcggttatttctttcctccgtgaccggcacgtctacgataatcagggtatactcgtcctcaatggtaatacgacacatttcttccgcatcgagcggtgctcgaaggtcggcaatatcaatatcgaaggtgttggcgatttcgagtgattcattttgagtcggattgacgagattgatccaagtacccggttcaagcgtatcgatctctttaaattcagttgttgtagagagaaaaacttgtttcatagcccttagcctttctcattcttcagattttttcacactgtactattatactacaaaatcgg

SEQ ID NO: 14 - DNA, 761 bp; single-stranded, linear
ttgnggagagacttnagtattttgtggcagacagacctcgataatcaccacaggcactaggaaccagtggacactgcagagtgagtgcttcaccactgcgcatagatttaccaagcaacttctttgcaatagcaccagccacgaacctgctaccaaactgtttttcagcatagagtaggcaaacataaacccgcaaaggactggaagcatcaaaccaaaggcagctccaccaattttcatggaacatagaagctaaactcatggtaagaaccaagattgccaaggttttcatttggaacactcaaagcaccgtcaatcaagaaggcaagggcaatcatgataccaccaccgataacgaatggtaacatttgagatacaccactcatcaagtgtttgtagaaggcaccaccaaggctttgtttttcgttagaggctgttgcgactttggcaccattagcggcacggtagacttccgcatctcctgaaatagccaagttgatcaattcttctgtcttacggataccgtcagcaactggacgattgatcaaaggtttgccatcgaaacgatccatttcaacggccttgtctgctgcaatgataatagctttagccttacggatatcttctgcagttagttgatttccaacaccgctagcaccgttggtttcgaccttgataccaacccccatttcagcagctactttttgaagggcttcttgggccatgtaagtgtgggcaatacctgttgtacaagctgtaac

SEQ ID NO: 15 - DNA, 693 bp; single-stranded, linear
ctctaaaacgaattctctacaagcaccgcaagggcatggctgaacttccaccataaggtggtttgtctcgaaaggctaatacttcnttaaccttagtttgtcctgaaaattggtacatattgaagagggccgcccgttctgcgcagagatggaaaacaccacaggttccctccatacagaatcctgtaaatatttgtccatctcctgcttctactgcagctacaacatgattggcataaacaaagtctgatacttcatgtggattgtatagtttctgtgcttcttcgtacatcttttcccagatgtccattattgtatcctctttatttagagatttcttttagaatgttttcgatatgctgaattgatttttcacgtccaagcaagaaaattgtatctggtaattctggcccatgcatttcgcctgaaactgcgatacgaataggcatgaaaagatttttccctttaatacctgtttctttttggactgctttaatttgcgggaagatattttctgtcacaaattcatcatctgtcatccgcttcaagttttgctttgaatgcttcaagaactgttggaactgtttcacccgtcatgacttcgcgctctgcttctgtcaattcctgggaaatctgagaagaaagatctgtccatgggatatctcatctactgattcattgtggtttatagag

SEQ ID NO: 16 - DNA, 713 bp; single-stranded, linear
ctgtatctagtggcaacgccgattggcaatctagatgatatgacttttcgtgctatccagaccttgaaagaagtggactggattgctgctgaggatacgcgcaatacagggcttttgctcaagcattttgacatttccaccaagcagatcagttttcatgagcacaatgccaaggaaaaaactcctgatttgattggtttcttgaaagcagggcaaagtattgctcaggtctctgatgccggtttgcctagcatttcagaccctggtcatggatttgggttaaggcagctattggagggaagaaattgcagttgttacagttccaggtgcctctgcaggaatttctgccttgattgccagtggtttagcgccacagccacatatcttttacggttttttaccgagaaaatcaggtcaacagaagcaattttttggctctaaaaaagattatcctgaaacacagattttttatgaatcacctcatcgtgtagcagacacgttggaaaatatgttagaagtctacggtgaccgctccgttgtcttggtcagggaattgaccaaaatctatgaagaataccaaagaggtacaatttctgaattgctggaaagcatctctgaaacgtctctcaagggtgaatgtcttctgattgttgaaggtgccagcaaaggtgtggaagaaaaagatgaggaagacttgttcttagaaatccaag

SEQ ID NO: 17 - DNA, 670 bp; single-stranded, linear
ctttaaggaaaatcaaatctctcatgctgatacctctcctcattaaattaaatagtaaaaaagattctatctcactccctgattattacaaaaccattgaaatatcacaactaataggctagaatggacatagtaagatntagtagatgagtcattctactcaaatccacgttagaaaggactgctatgccagacaatctcgcgcttcgcatgcgccctaaaaccatcgaccaggtcatcggtcaggagcntctggtcggacctggaaaaatcatccgccgcatggtggaagccaaccgcctgtcctccatgattctatatggccctcctggaatcggcaaaaccagtattgcctctgccatcgctggaacgaccaagtatgccttgcgagacccccaacgcgacagttgatagttaaaaagcgactgcaaaaaatctcggaagaagctaaattttctggtggtctcgtcctattgctagacgaaatccaccgactagataagaccaagcaagacttcctctggcctctcttggaaagtggactggtcatcatgattggagcaacgactgaaaatcctttcttctctgtcactcctgccattcgtagccgagttcaaatttccgagttggaacctctgtctaaccaaaacgtcaaaggaggccccgcaaa

SEQ ID NO: 18 - DNA, 575 bp; single-stranded, linear
ctcttagtatcntgattatggcgacttatgaaaccttcncggcggtctatgatgcggtcatggacgaatagtttatgcgacaaatggacgaatttttctcatgcgtcatttgcctaagaccgaaggagagaaagaaactcttggaattggcttgtgggacaggaattcaatcagtgcgcttctctcaggctggttttgatgtgactggacttgacttgagtgcggatatgttgaagattgcggagaagaggagcaacttcagccaagcaaaagattgcttttatagaaggtaatatgctaaatttgtccaaggcagggaaatacgattttgtcacgtgttattcggactctatctgctatatgcaggatgaggtggaagtaggggacgtctttaaggacgtgtacaatgcgctgaatgaagaaggagttttcatctttgacgtgcactcgacctaccagacagatgaagtattgccctggctattcctaccatgaaaatctcggaagattttgccatgctttgggatacatatgagggcggagctcctcactccatcgtgcatgagatcgagcct

SEQ ID NO: 19 - DNA, 507 bp; single-stranded, linear
cttgtctttaattgataatgatccttttaaagatgatgaagatttcgtgtcaacctatgaccttgataaatcttttatttctatggtatctgttgatgtatcagaatacctaggaagtcaggaacccattaaaaagactttgaccataccaaaatgggcagataagttgggacgagaaatgggacttaacttttctcagactttgacagacgctattgcagataagaaagttcaagcctaagattaagcgtggtatcgtggtaatagtcaataaaaaagcacgtccacttgtgctagttactcgcctattgattttatagatttattagccctttcgagggctttttatattgatttttatgagaaataaagaaatcagacttttaagaaaatcattgataccaagggtttaaatgaggtaatatggtataattaggacataaaataattttgtggtaagatggtagtatctattttagcatatttccgagcaacggggcgattaaa

SEQ ID NO: 20 - DNA, 666 bp; single-stranded, linear
ctttgacaaagagtatgacacctgaccgtgaagtcattacctttattcctgaaaaatttattgtggatggtttccaagggattcgtgacccacgtggcatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaacgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtaaaggttattggagaagtagaaccagtcaaagtgacggaagcctacttgtcagaaattatttctgcacgaatcaagcacatccttgaacaaatcaagcaagaattagatagaaggcgtctggttggacctccctggtggtattgtcttaatcggtgggaatgccattttaccaggtatggttgag

SEQ ID NO: 21 - DNA, 703 bp; single-stranded, linear
ctcgtacaaacggtatgggatttgcacgtgacaagatggttattaccagtgtaaacaaaaacctagaattgacagctaaatggattgatgcacaatacgctccactccaatctgtgcaaaataactggggaacttacggagatgacaaacaacaaaacatctttgaattggatcaagcgtcaaatagtctaaaacacttaccactaaacggaactgcaccagcagaacttcgtcaaaagactgaagtaggaggaccactagctatcctagattcatactatggtaaagtaacaaccatgcctgatgatgccagaatggcgtttggatcttatcaaagaatattatgttccttacatgagcaatgacaataactatccaagagtctttatgacacaggaagatttggacaagattgcccatatcgaggcagatatgaatgactatatctaccgtaaacgtgctgaatggattgtaaatggcaatattgatactgagtgggatgattacaagaaagaacttgaaaaatacggactttctgattacctcgctattaaacaaaaatactacgaccaataccaagcaaacaaaaactagaggttgattatgggagataagaaatacacagtagaaaaagccaatagttttatagcagaaaataaacatctcgttaatactcaatataagcctgaaggacatttttcag

SEQ ID NO: 22 - DNA, 673 bp; single-stranded, linear
ccacaacaactctcgtntgatcactatgggggcacaacttgttggtgatgaattggctaaaaacatcgctaaaggatttgttaatggtaaatacgaccgtcnacatcatcaaatccgggttgacatgttgaacaaaatgggctaattagattacagtaagaaaggtaagttaaaaatgagaattgcaattggatgcgaccacttcgtaacagatgaaaaaatggcggtttcagaatttttgaaatcaaaaggatatgaagtcattgactttggtacatatgaccatacacggactcactacccaatctttggtaaaaaagtacgggaagctgtaactatcggccaacctgatcttggagtatgtacctgtggtactggtgttggtatcaacaaccctgtaaataaagtcccacgtgttcgctctgccttggttcgtgatatgacaacagccctttatgctaaagaacaattgaacgccaacgttatcggttttggtggtaagattactggtgaattgctcatgtgcgatatcatcgaagctttcatccatgctgaatacaaaccatctgaagaaaacaaaaaattgattgcgaaaattgaacatgttgaaacacacaatgctcaacaaacagatgcaaacttcttcactgaattnccttgaaaaatgggatcg

SEQ ID NO: 23 - DNA, 508 bp; single-stranded, linear
ctactttccgccagagttttgaggtcgctagaacattttgcttatcgatactagtaacgatttttctgcgatttcttgcaatttcaaaggctttgcgaataatccgctccacttcctcatagctatagtcgttgatatcacgcgctttgcgctcttcaagaatatgatctccaaagtaaatctcgcctaatcaattaacgcaccacgacaaagtatacaccagaaattcgttccggtttgagtggtgacaaatacttgagactgtcaaagatttttacaggacgaatattagcgtaaagattgagttcttacggagagccatcaggccttgttcagggcgaaccgctactccatcatactgaggactaccgatagctactagtaggatagcatctgcttccctacttgccttaagggtttcatcaggtaagggaggtcctgctgcatcaatatctgcacctccgaacggtcgtctgtcaatctncatagtcaaaacctgttttttcag

SEQ ID NO: 24 - DNA, 499 bp; single-stranded, linear
ctcttgtcagagaaatttacaaaacgttaggagaataagatggcatttattgaaaaaggtcaagaaatcgatatggaagtcatcaaggctgaaacccaattgtctgcagaagccttgagactcaaggaaagccgtgacagggaattggcagatattatttcaggggaagatgaccgtattctcttggtgattggtccttgctcttctgataatgattaggcggtcttggaatatgctcgccgtttatccgccttgcaaaagaaggtagcggataagattttcatggtcatgcgcgtgtatactgctaagcctcgtaccaatggagacggctataaagggttggttcaccagccagatacttctaaggctccaaccctgattaacggcttgcaggctgtgcgccatttgcactaccgctttgattacagatactggtttgacaacggcagatgagatgctttatccgtcaaatctgatcttggtggatgactttggtcac

SEQ ID NO: 25 - DNA, 354 bp; single-stranded, linear
cttgtcataatttacaatttagttaataagaccaaaaaggtcatatatataaaggagtcacaaaaatcatgaacaaacgtgtaaaaatcgttgcaactttgggtcctgcggtagaaatccgtggtggtaaaaaattcggtgaggacggatactggggtgaaaaacttgatgttgaagcttcagctaaaaacattgctaaattgattgaagctggtgctaacacattccgattcaacttctcacacggcgaccaccaatgaacaaggtgnagcgtatggcaactgttaaacttgcggaaaaaattgcaggtaaaaaagttggtttccttcttgatacaaaaggacctgaaatccn

SEQ ID NO: 26 - DNA, 540 bp; single-stranded, linear
cttctttactgagatggattttcctttttagttcgtgccaatctcaaggcacgatttggattgagacgattaaatagttcttccaatttcttttcattccaaacgtctgcggcggaaacaaaattaccatccgcatctcggaaagatatcggtttatctcccataccagtctcctagtctacaaattcaaactcaaatttaccaatgcggaccaaatccccatctttagctccacgcgcacgaagggcttcatcaacccccataccacgaagctgacgggcaaatttcatgacagattcatcacgatcaaagttggtcatattaaagagtttcatgagtttttcaccagaaagtacccatgtcgcatcgtcatcacgactaatttcaaaggctttttcttcttcgtcaaatccatagtaagcttcttcttccatatcagactcgtcgtagagcaaaaattctggtgtcttgtctaacaattcagctgtagcatctaaaagtgttgccagacttgcttggtcaatccagaaattgggaaga

SEQ ID NO: 27 - DNA, 333 bp; single-stranded, linear
gactaaaggtgcaggtgccagatgatcgtcaccaacgtatcagatagtcaattactttcccaaatcttactcaatcttttatccaatgccatccgttacactgaacaagggggaaaaattgaggtcaagacccaaaaggtgaacgaaggcattaagatttctgtatcagatacagggcattggtattagtcaattaaagcatgatcgtacccctgaccgtcactaccgagttaccaaaggtcgaaactgagattccggttagccacggtggtggccttgccattgtcaaagaactcagtcaatttattaggtggccgnagtcacggtgacgac

SEQ ID NO: 28 - DNA, 272 bp; single-stranded, linear
ctgaacataggcttagaaggagtctaccagcaggagaatgcagccttggcgttgcaaacttttcttctctttatgggagaaggannggaagctgtcgatgaacaggctgtaagaaaggccttggaacacacccattgggctggtcgcttggagcgtattcgcccacagatttacttggatggtgctcataacctccctgccttgactcgcttggttgacttcatcanccaanaantatcatgagggtcatcgtcctccaatccttttttgga

SEQ ID NO: 29 - DNA, 1159 bp; single-stranded, linear
ctgcatcagccaaagctttcacacgtccgtgatatagatatccaccgcggtcgaacaccacttctgaaatacctttagcgtttgcacgttctgcaacgagtttaccgacagcaacggcttgttcagttttagttccttttgaaacttctttatcaagagttgaagcacttgcgagcgttacacccgctacgtcatcaatcacttgagcgtagatgcctgtattagaacggaatacgttcaaacgtgggcgatcagcagttccagagagttttccgcgaacgcgacggtggcgtttttggcggagtttgtttttatctggttttgaaatcacagttttcacctctttagttttaaatcgtgtgctatgcacaaagttggaaaataggttggtggttgatgatcaaccactcaacattatttacctgttttaccttctttacggcgaacgaattcaccaacgtaacggatacctttacctttatatggttctggtgaacgaaggctacgtacgtaagcagctgtttgaccaactacttcttttgaaattccgctaacaacgattgttgttgggtttggaagttcaaaagtaattccttacagcttcaacttcgtctggatgagatttaccaacagccaaaacaagtttagatccttgaagctgtgcacggtaaccaaccccacgcatttcaagttctttcttgaatccttctgatacaccaacaaccatgttgttcaaaagggcacgagtagttccgtggatagttttcatttcttttgaatcgtttggacggtgaaaagttatttcagtaccttccacacggatttcaatatcttttgagaactcacgagtaagttctcctttaggtccttttacagttacaacgttgtcattgttagcgagttcaacaccagcaggcaacacgataactttattaccaatacgtgacatgtttattttctcctgttaaattgtcaggccagaacggccagttttcacggggttcaaatacttatttagttcaagagccatccaaactctcccagcagacgatgaccacccagtagataccatcgcccaagtctttcaaaaaggctacaaactccatgaacgcatccctacgcccagccaatggtagtggtgttataactaagaatacaa

SEQ ID NO: 30 - DNA, 901 bp; single-stranded, linear
cgatcggacaagaatctattctgtaaattgcgacacgaggagtcgaaatcgattttacttcgacgacgagttagtaaggaagctagacaaacgccatagcgattgccgttttctgacgagttgctttagctaccgtcagaattgccgaatcgaacacgccctaagctctgagtaaaaaagatagattttcttgtgttcatcgaacaattcgtcaatctcctatttttactgcgagctttttacgggctttgtatcttagttatacaccactaccattgctgggcgtaggatgcggtcatggagtttgtagcctttttgaaagacttgggcgatggtatctactgggtggtcatcgtctgctgggagagtttggatggccatatggtagttatggtcaaattcgccatctgctgcgatttcttcaattccttcttctttcaaagcgtgaatcaagctttcttgcaccatccccaagcccttcttcacatcatctgtcaaaccttcaactgcaagtgcacgctcaaggttgtcaagagatggtaagattgcttttgccaagtcctggctacgataacgttgcaagttttgacgttcttcattggcacggcgttggatattttgcatttctgcatgagcgcgaagatatttgttttcgaactcatctgcacgttcatttgccaagtccaactcagacttttcaggagttgtttcttcagctgtttccacaacttcctcttcttgaacttcttctacttctccattttttatatcttgggccatgttcgcctccctttaatgatttcaatcttaatgtacttcataacgattactgctgaggtagcggtaaaaatctgtcnncntcatagtcaaaacacggtgaacacattgactngattgataa

SEQ ID NO: 31 - DNA, 766 bp; single-stranded, linear
ctnttgtcaaaagtattgctatccttattcatagaataaagaatacggcgctgaaccggcttcaacccatcacgaatatctggcaaagcccggtcttgaataatgtacttggagtagcgaccaaagcgctctcccatgatgtcctccagggacatgttttgaatgttagacataagatacaaagcccataaaataccaagtgaaaatagaaaattcttgaagtaagcaaactcacaagagaatttatctttttcacacagtatctagggcgtgttcaactcctttcaaagaatgtagagtaggtttttatgcagtaaaagatattttacgggaattcgtcccgtgttcagttacgataagtaaccaaactatcctgtttgtatttttcaatatgaaaatatggttttccaaaattagtcttagtttgtgtcttagccgctcccttaaacgcctctttgagataagcactcatagcagattcttcattaataatcctgcaattttttcaaaccaagattttcaaactgctttttcacatagtcattcacatccgactctaatttccagtttactaacatattattttctttcattaaaacactgtcgcttcttctagcgtaaacttgacattatcttcaatccatttacggcgtggttctaccttatctcccatgagaacattgacgcggcgttcggcgcgcgctaaatcttcaattgtgacacggatgagggtacgtgtttctgggttcatggttgtttcccagag

SEQ ID NO: 32 - DNA, 831 bp; single-stranded, linear
ctcgtgttcaaattggcaagcccaattgaacccgggctaaactctgtgtgaaaaagataaactttcctagaaactttagtttcttcgtcaagtttcctatttttacttggagttttgacgctcttgatatcttaaattaccaagatgcttttgttacaccaggaatttgacctttatgcgcaagttcgcgaaaagcgatacgactcagaccaaatttgcggtaaactgaatgtgggcgccccgtaactctacaacgattatgtaaacgagtcggtgaggcgttgcgaggtaatttagataaaccttcgtagtcccctgccgcctttaatgcagcacgtttttcagcataacggtcaacaattttttggcgtttagcctctctagctaccattgattttctagcaattagatttacctcctatattattttgcaaaaggcattccaaggccttgtaagcaatgcacgtgactcttcgtcagtgttagcagttgttacgataacgatgtcaagaccacgagttttgtcaacgtcatcgaagttgatttctgggaagattaattgtnctttcacaccaagtgtgtagttcccgcgtccatcaaatgattttgttggaacaccgtggaagtcacgtacacgtggaagtgaaactgataccaattnacccaaganttcgtacatacgttcaccacgaagggtaacttttgcaccgatcgcnacaccttcacgaagacggaagccggcgattgatttnttagctctagtgatnagtggtttttgaccngagataagtgccaattctccagcagctttttcaggcttttagcgtttga

SEQ ID NO: 33 - DNA, 1194 bp; single-stranded, linear
ctactcgtacaggtgcacaagttgcgggtccaatcccacttccaactgaacgtagcctctacacaatcattcgtgcgactcacaaatacaaagactctcgcgaacaatttgaaatgcgtacacacaaacgtttgatcgatatcgttaacccaactcaaaaaacagttgatgccttgatgaaattggatcttccaagtggtgtaaacgtagaaatcaaactttaatctaaaatataaaagagcagaggctggtgtttcaatctaattgaacacggactaaactcggtgtgaaaaagataaacttcctattgtccgttagacactgcgttagtttcctattttcactttgagtttgacgccctttgtatcttagacttgagcataaaaaacgctcgttaaaaactttttgaataaaaaatatagaaaaggaactattttctcatgacaaaaggaatcttagggaaaaaagtgggaatgactcaaatcttcactgaagctggcgaattgatccctgtaacagttattgaagcaactccaaacgttgttcttcaagttaaaactgttgaaacagacggatacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggcgctgaaatcacagttgaaacattcgcagctggagatgttgttgatgtaactggtacttctaaaggtaaaggtttccaaggtgttatcaaacgccacggacaatcacgtggaccaatggctcacggttctcgttaccaccgtcgtccaggttctatggggcctgttgcacctaaccgcgtattcaaaggtaaaaaccttgcaggacgtatgggtggtgaccgcgtaacaattcaaaatcttgaagttgtacaagttgttccagaaaagaacgttatccttatcaaaggtaacgtaccaggtgctaagaaatctcttatcactatcaaatcagcagttaaagctggtaaataataaagaaaggggaaatcagtcacaatggcaaacgtaacattatttgaccaaactggtaaagaagctggccaagttgttcttaacgatgcagtatttggtatcgaaccaaatgaatcagttgtgtttg

SEQ ID NO: 34 - DNA, 1526 bp; single-stranded, linear
ctcctcactatctacactgcttaaattggtcaaatgaacttttttacaaccataaaaaagagcacttaatcgtactcttctcttttaaggattagttgaattaattcaaatccactagttctcctgtttctaggtagactaggcgttcacaaatgttagcaatgtaatcagcgaagcgttccagatgccctatgatataaaggtattgtgttccattgggaattgaggtttcttggtctttcataagtccaatgatttcctttgataaggcataataatattggtcaatctgttcatctttttgagcaatactaatagcttttgaggcttggtgcaaaggaaaggcaaccaataaatcggctagcatgctgagggataatttacccatttggtgtaactgttcttcgccaggggctagttgattttcttttagttgcaaaacagctttggcaatgcctgccatatggtctcccatacgttcaaggtctgaacaagaagacatgatgctaatcacaaatcgaaggtcagacacttgtggctgctgcaaggctaacaaacgggcacaggtcaattcgatagcgctttgaccttggttgatagcatgatccttattgataattagctttgccatctccttgtctttggaggctaaggccagtaaggcttttgaagctgtttcaaggacaagttgccctagtcctaaaaaggattgttctaattcatgcaattctaagtcaaattgatttctcataggtttttccttccttatccgaaccgtcctgaaatatagtcttctgtgcgctgatcttttggattggtaaacacgtcaacggtatctccaaattcgcaaatttctcctgttaagaaaaaagcagttttatctgaaatacgtgaagcttgttgcatgttatgggtaacaatgataatcgtataatccttttttagttgctgaatgaggtcttcaatttttaaagtggagatagggtctaaggctgaagtcggctcatccattaacagaatatcaggttctactgctaaagctcgcgcaatgcaaaggcgttgctgctgaccgccagataaggacatggcactctttttaagatcatctttgacttcttcccaaatggctgccccttttaaagatttctccactaaggcatctaattgttttttgtctcgaataccatgtgtccttggaccataagccacgttatcatagatagacatggcaaagggattaggctgttgaaaaaccatccctacacgcttgcgtagctgattaaggttgaatttgctactataaatatcttgctcatctaagaggacttggccttcaatatggcaagaaggaaccaaatcgttcatccgattaagggtttttagaaaagttgatttgccacaaccagatgggcctatcaaggcagtaatctgtctttctggtaattgaatcgaaatattttttaaggcttgaaaatccccgtaaaataagtctaggtgtctgactgaaaatgttcccatactagaag

SEQ ID NO: 35 - DNA, 1738 bp; single-stranded, linear
ctggggcagacgcaccgaagatgtcaataccgatgnccgcgccatccaaaccaacatacttgtaccaactttgggtcgctgccatttcaatggccacacgacgacgagtcttagatggtaaaatgtcttccttgtaggtagcatcttgagcatcaaatagttcggttgagggcatagataccacacgtactttaccaccttgtaaaaccaattccttagcagctttgatagctagattgacctcagatcctgtagcaatgataatagtatcaaatcccggggtatcatacacgacgtaggctcctttagcgaccttaccaaagtctgtcccttcttcaactaccaagttttgacgggttaagacaatgacagttggagtggtggtactggtcaaggcatgatgccaagtcgcttgagtttcacgggcatccgctggacggataacagtcaagtttggcattgagcgtaaacctgccaaatgttcaactggttcatgagttggaccatcttcaccaacggcaattgaatcatgggtaaagacataagttacaggcaactcctgaatggctgatagccgaatagcagctttgacgtagtcagagaaaacaaagaaggttccgccataaactcgtaaaccaccatgaagagccattccattgaggattgttcccatgacaaattcacgtaccccaaactgaatattgcggtttaatggattatatttatcttgtaagccatctgccttgatgtaggtcatgttggagtgagctaagtctgccgatccacctaagaaggttggtaaaactgctgctgtattaatagcatcttgggacgaattacgagttgcttgagagaagccattctcatagacagggaagtctttttcagtaatggttacaggggattttccagtacaatagcgtcaatctcactagcaacttcgggataagcaaccttgtaatcagacaccaaactagcccaagcatcgtatgcctcctgaccacgatccgctacatttgtcttgaaatcagaatatacttcctctggtacttcaaatggatcgtaatcccatcccaaaaacttacgagttgctcctgtttcttctgctcctagtggtgcaccatgaacagcatttgtaccacttttattgggtgagccgtaaccaattaccgttttcacttcaatcaaacatcggcttgcctgaaacttttgctgtttcgatagcagcatggatggcttccaagtctgttccattttcaaccaaggcagtatgccaaccgtaggcattgtaacggtcacgaacactttctgtaaaggaatcctttgtctcaccatccaagttgatatcatttgaatcataaagaacaaccaacttatcaagtttttgcaagcctgcgtatgaagctgcctcgcttgagacaccttccatcaagtctccgtctccacagataacgtaagtatagtggtcaaagatattgtagccttcacggttatatttggctgccaagaaacgttctgcttgggcaaaaccagtagcagttgaaatcccttgccctagaggacctgtcgtagcatcaatccctgccgtatgaccaaattctgggtgacctggtgtttttgaaccccattgacggaagctccttaatctcatccatgctgacatcttccaaaaccagaaaggtgaagaagagcataaaggagcattgaaccatgacctgctgaaagaataaagcggtcg

SEQ ID NO: 36 - DNA, 810 bp; single-stranded, linear
cttgggagctattttgcttagttttcgccttattcctcaacttggctggggacgtggtctttttagttccatttttctagcgatctcagccttctgtaatgccggttttgataatttagggagcactagtttatttgcttttcagacagatttactggtcaatctggtgattgcaggcttgattattacaggcggccttggttttatggtctggtttgatttggctggtcatgtaggaagaaagaaaaaaggacgtctgcactttcatacgaagcttgtactattattgactataggtttgttgttatttggaacggcaactactctctttcttgagtggaacaatgctggaacgattggcaatctccctgttgccgataaggttttagttagcttttttcaaacagtgacgatgcgaacagctggcttttctacgatagattatactcaggctcatcctgtgactcttttgatttatatcttacagatgtttctaggtggggcacctggaggaacagctgggggactcaagattacgacattttttgtcctcttggtctttgcacaaagtgagcttttaggcttgcctcatgccaatgttgcgagacgaacgattgcgccgcgaacggttcaaaaatcctttagtgtctttattatctttttgatgagcttccttgataggattgattctgctagggataacagccaaaggcaatcctccctttatccacctccatatttgaaaccatttccagctccttagtacagttggtgttaacggcaaatctgactccctgaccttgggaaatt

SEQ ID NO: 37 - DNA, 2179 bp; single-stranded, linear
ctcaaccctggcatggaaaatatccatgtagcggctggagatttgcttaagggtgtggaaattgaggcagatgtgattgtggctaatatcttggcggatatcctcattcatctaatagacgatgcctatcgtttggttaaggacgaaggctacctgatcatgagtggcattatcaaggataagtgggacatggtgcgcgagtcggctgaatcagctggatttttcctcgaaactcacatggttcaaggggaatggaatacctgtgtctttaagaaaaccaaggatatctctggtgtgattggaggctagcatgcagcagtattttgtaaaaggcagtgctatctctcctgtcactatcgaggacaaggaaaccagtaagcatatgtttcaggttatgcgcttgaaagaagaggatgaggttaccttagtctttgatgatggcatcaagcgcttggcgcgcgtgctggatatggaaaatcgtcagtttgagttggtccaagaattaaatgacaatgtggaactaccagtccaagtgaccatcgcatctggatttcccaagggagacaagctggagttcatcgctcaaaaagtaaccgaactgggtgctagccaaatctgggcctttcctgcagactggtcagttgccaagtgggatggcaagaaattgggtaaaaaagttgaaaaactagaaaaaattgcccttggagcagccgagcaaagcaagcgtaatattgtaccaagtattaaacttttcgagaaaaaagcagattttctagctcagctggaccagtttgattctatcatagtagcctatgaagaatcagctaaagaaggagaagccgctgcgcttctgcaagcagtcactggtcttgaaacaggagccaaactgctctttatctttggtccagaaggtggtctgtcacctgcagaaatcgaaagttttgaagctaaaggagcagttttggcaggcctaggttctcgtattttgcgagcagaaacagcaccgctttacgccttatcagcccttagtgttttagtagaattagagaaataagaggaagaaaatggaacaaaaacaccgttcagaatttccagagaaggaactctgggacttaacagccctataccaagaccgtgaggatttcttgcgtgcaatcgagaaagctcgtgaagacatcaaccagtttagccgtgattacaagggcaatcttcacacttttgaggatttcgagaaggcctttgcggaattggaacagatctacattcagatgagccatattggcaactatgcttttatgcctcagacgacggactatagcaatgacgaatttgccaatattgcccaagctgggatggaatttgaaacagatgccagcgtagccttgaccttctttgacgatgccttggtggtagcagacgaggaagtcttggaccgtttgggtgaattgcctcacttgacggcagctattcgtcaggccaaaatcaaaaaagcccactatctaggggctgatgtggagaaggccttgaccaatctcggtgaagttttctatagtccgcaggacatttatactaagatgcgagctggggattttgaaatggctgactttgaagcccatggcaagacctataaaaacagctttgtcacctatgagaattctaccaaaatcacgaggatgctgaggttcgggagaaatccttccgttccttctcagagggacttcggtaagcaccaaaatacggctgcagcagcctatctggctcaggtcaagtctgaaaaactcttggctgatatgaagggatacgactctgtctttgattatcttctagctgaacaagaagtggaccgtgtcatgtttgaccgccagattgacctcatcatgaaggactttgcaccagtcgctcagagatacctcaagcatgttgccaaggtaaatggtcttgaaaagatgacctttgcagactggaaattggacttggacagcgccctgaatcctgaagtgactattgacgatgcctatgatttggtcatgaagtcggtagaacctttggggcaagaatattgtcaggaagttgctcgttaccaagaagagcgctgggtggactttgctgctaacagtggcaaggattccggtggttatgcggcggacccatatcgcgtacacccttatgtactcatgag

SEQ ID NO: 38 - DNA, 2575 bp; single-stranded, linear
cttaaggttttcttcnatactttggttttcaattaacccanagttctggaagaggtagcccaattcntgacggagaaaatcnctcgagttatnattggccaagtctttacctcggtaanaaatcgtcccagcataaggttctaatttcccaatcatgttcatcaaggtgttttccgctatcacttgaaccaattaaggcatagattttccagcctcaaatgtcattgaaagattcgaaaataactctcgttctccaaaagatttactcacctgtttaagttcaatcatattaacctcccttcaaaacaagaatggacatcttgttttctttctgcatttggacatgtaactgtaaaagagatagaccagtaaagagtaacaagactaagaaagcaactcctatctctacctgaagaaatacactcgcaacaaatcccagtaaaaacacacccagttgagcaaagagataagtgcgatggatttctaagaacctgagacctgcaatgcgtttgataaaaatggcacgtctaaattcttcaaagtagagcctattcatagtgttaaacaacaagattgaagttgcaatcccaagcacagctcctgctagcattacccaacgttccctctggatattatccaataatgtgatgtagttgtggtaacctgtttgcatttctgagacccaattttcaatgccttgtctctggataagctcctgggcatcagacaattgattaaagagaacgtagttctgtactgcgtctatccaaaacaaaatggactgtggaccagttgattggggtgttataacaatgatgattggatctttcaaaaactgctggtaagaaataggggtcgtattatacacaaaacgatcctgacctgattctaaataacctaccgtagcagtcatttgctgtcgttcatcttgactagacatgcgactggttaagtcgtcttcaaaaacagatttataatgttcttcctctgaacggaggtgttcaggcagcaataagacaaactcccctacatcaaggtgattcatcttttgctcaatagttgtatctacaggaatgttttgacgctccaagtattgcggtgtgacgataaggacattgccattcgggttgtaatcgtgccattctgtagaggttatcaagtttttggaggaagccatgccattttgcaaagtacggtcaattaactggtgtctagataagaaagccttttgttctgaaacagccagatccatcaattgataccaagttctgagtttcctttgagcttgttcatcaaaaccaggactcgttccttcacggctgattgatagggtaatcagttgcctttcctgactccaaacctcttgtccaatccgatgctgttgccaggcttgggaatactttaagctactccctattcccagcgttacaataataatcgctaatagttgaccgattaaaatcaaactaatgattcctctgacaggcacttgcccttttataatctgcatcaggtgtatcttttttatcccaactgcgaagagttgagcgaaaaacagggagatcgacaacaagatgagattataactgagcaagcctgctcctatggtcattagggattgcgttggaagcgacagaattttttgcataagaatggcgagcacgccagctaaactgaaaccaacagctatccctttcaaatcctcaccaactggtctaaggaaaatggaccaccgtttctctcctgaaatgaggcgaatgcccgacgaccgtaattggctaatttgactaattaaagtcagtgctacaaaggttaagatgaaaatcaatagactgattaactgaaatccgttactaaagatagccattaacgtagatagtttagatggaattgtcaggttcatattagtcaagccaagttgacttagctcctcccttagcaagtgaatatctaggtgtccatcgaatacaaaatagtttgtttcaacactactactttgagcatcttctagttttttttcctgaagcccatcaggcaactttccgtccccaaaggttgtataagaaaaaactgtagtaccttctgagttaggatcttggtgttgaatcgcaataaagctatctgtttcttctgctagtttttccaagcgtgtagcaacatgctgaaaagttgtttcaggggaagaatcatgtacaacaacgttggggtaataataggagacatatgtatcagtccaaatggtaaatacccaaacaaagaacaaactagcaagcaggttggatatgagtataaataattttttcatagtgcattccttattctaaaacagagggcagaaatacgcctaccctctataaactaacaagtttactaaactattgataaaagaatcttcttcaattattctttaccatcccgcatcaaatgtaaattttaacatattatttactcctctgaaatgaaatttatgaaaatgaagcgaaaatggcaactacatattttaatcagaaaatctcagtctgaattatagtatcctatttttcccctcctttcctaacctggcacgttcctttct

SEQ ID NO: 39 - DNA, 1692 bp; single-stranded, linear
ctattcggaataagaaaaatgccagtatggtattggcagccaaggctgtcaaagatggtgaagcagacgctgtcctttcggctgggaatacaggtgctttgttggctgctggattcttcatcgtgggtcgtatcaagaatatcgaccgtcctggacttatgtcaacattgccgactgtagatgggaaaggttttgacatgcttgacctcggtgctaatgcagaaaatacagcccagcacctccatcaatacgctgtcctaggttctttctatgccaagaatgttcgtggcattgcgcaaccacgtgttggtttgctcaacaacggaacagagagtagcaagggcgacccgcttcgtaaggaaacttatgaattactggcggctgatgaaagtttgaactttatcggaaacgtggaagcgcgtgatttgatgaatggcgttgcagatgttgttgtggcagatggtttcacgggaaacgctgtgctcaaatccatcgaagggacagctatgggaatcatgggcttgctcaagacagctattacaggtggtggtcttcgagcgaaactaggtgccctccttctcaaggacagcctcagaggtttgaaaaaacagctcaatcattcagatgttggtggagcggtcttgtctggtgtcaaggcacctgttgtcaagactcatggctcaagcgatgccaaggctgtttatagtacgattcgccagattcgtaccatgctagaaacagaagtagttgcccagactgcgcgtgaattttcaggagaataaaagagatgaaagaaaaagaaatttttgacagtattgtgaccattatccaagagcgacagggagaggactttgtcgtgacagaatccttgagtctgaaagacgacttggatgctgactcagttgatttgatggagtttatcttgacgctggaggatgaatttagtatcgaaatcagcgatgaggaaattgaccaactccaaagtgtaggagatgtggttaaaatcattcaaggaaaatagcaatcggagttccaagtcaacggaagtagatggtttttagaaatgagaaatatcggacaagctggtaaaatcttggctgacagtggttatcaagggctcatgaagatatatcctcaagcacaaacttccacgtaaatccagcaaactcaagccgctaacagttgaagataaagcctgtaatcatgcgctatctaaggagagaagcaaggttgagaatatctttgccaaagtaaaaacgtttaaaatgttttcaacaacctatcgaaatcatcgtaaacgcttcggattacgaatgaatttgattgctggtattatcaatcatgaactaggattctagttttgcaggaagtctaatagtaaaaaagtgattagaaaacatcttttttaaaaatagagatgattttgaaacaaaaaagctaattcaagacgtttcgatgccaattcaagatttggatgaaaaaaattaatagatactgttatactaaacttgtcaagtttgtaacaagacaaatattaaaaataaaaaagaggtattcgttatgaatacaaaaaagatgtcacaatttgaaattatggatactgagatgcttgcttgagttgaaggtggcggatgcaattggggagattttgccaaagcaggtgttggaggaggagtagcacgaggtcttcag

SEQ ID NO: 40 - DNA, 1117 bp; single-stranded, linear
ccacgttggggtcttagtacctgctgatgacggtttcttatttgtagagaaattgactttcgaagagccctaccaagcgattaaatttgctagtaaggaagattgctacaagtatttgggcaccaagtatgcggattatacaggcgagggactggctaagccttttatcatggataatgataagtgggttaaactttaatagtgttatgatatgacagtaatcttaggatttttatttctatttttgataagttggtgggttatttcaatcgttaatagccagaaaccacgcaaaaatgaaacatttattggctatgtccaaagatacgatattgatgggaatgccgtgatcaatcaataaccgtgtccttcagaactgagaggagttcttgaaatcgtaaaaccactttgaacaagagtaacttcaacccatcggctccgacggattaagtgctttcgtgaataccaaaatcagccgcaatttcttcataagtgcgatattctcgcacatattgaagagtggccataagaaggtcttctaggcttaatttaggttttcgtccaccttttgcgtgtttaagttgataagctgtttttaatacagctaacatctcttcaaaagtcgtgcgttgaacaccaacaagacgcttaaatcgtgcatcggttagttgtttacttgcttcatcattcatagaactactataccatattttatttcgcaggaagtctgatctcatccggttttgcttgacgggcttttgcggttatttcttcaaaagggacccaccagactggcccacagcccttgagaccgtggccattcatatcacctcttcgtctagggaaaaggtgccagtggagatgggcatcgccatttcctagaagttcaatattcattttctcagcagtaaaggccttggcaactgcctcttggactaaactcatttcttctagaaaatggagtcttgtgtccttttctaaaatggtgcaattccgcgacatgttccttggctaaaaaaaaactatagcttgcaagctcaatactgatggtctccaatcacaagatagcctgtttccaactctttgacaaagtagggattttctcccttcttgatga

SEQ ID NO: 41 - DNA, 1385 bp; single-stranded, linear
ctacagcgtagagttcagggtattcaattgaaatgcgtttaatcgtacgtgttgtagcatgttttctgacaaaaaacgggattcgcttaatcaagtcttgtgggactagcgccagaatcttctcagtagtttctttgtcactaatatnagacattgcaagccttttcttaatcatttcctgttctttttctgtaaaatcttttaattccattcgattagtcctcctattttctctaagttaaattatgtactaatacngatgaaactacaaagaataaactttaagaaatcttctcactgatcaagatttcttactttccaatagacttcctgcgaaacaaaatatggtatagtagttctatgaatgatgaagcaagtaaacaactaactgatgcacgatttaaacgtcttgttggtgttcagcgcacgacttttgaagagatattagctgtattaaaaacagcttatcaacttaaacacgcaaaaggtggacgaaaacctaaattaagcctagaagaccttcttatggccactcttcaatatgtgcgagaatatcgaacttatgaacaaattgcggctgattttggtatccacgaaagcaacttaatccgtcggagccaatgggttgaagtaactcttgttcaaagtggtgttacgatttcaagaactcctctcagttctgaggacacggtaatgattgatgcgacggaagtacaaatcaatcgccctaaaaaaagaattagcgaatcattctggtaaaaagaaatttcacgctatgaaggctcaagcgattgtcacaagtcaagggagaattgtttctttggatatcgctgtgaactatagcatgatatgaagttgttcaaaatgagttgcagaaatatcggacaagctggtaaaatcttggctgacagtgattatcaagggctcatgaagatatatcctcaagcacaaactccacgtaaatccagcaaactcaagccgctaacagctgaagataaagcctataaccatgcactatctaaggagagaagcaaggttgagaacatctttgccaaagtaaaaacgtttaaaatgttttcaacaacctatcgaaatcatcgtaaacgcttcggattacgaatgaatttgattgctggcattatcaatcatgaactaggattctagttttgcaggaagtctattaaaaattgagaaattaaaagagatgatattagggagaactgatttaggcaaagtgtctcccctagttacgacataaagaagcataaatcgataatatttatgtttctttactagtgaaacgcctagccaaattaccatagttacgacgtcatggatcctctaaatcgattatatttaggggtcatgactagtgaagcagttag

SEQ ID NO: 42 - DNA, 690 bp; single-stranded, linear
ctgagaaaagtggtggttgttcgattagaaaaaccagtaacttttcacaatatgatagctcctgataaggaagtagaagtatccttgctcttctttatcatcaataactcaagttcaagtcaaacaaatattctggctcagttgatggactttttcacaggaaatggacatcttgaagacctatcaaaaatttccgaaccagaaaaactttatgcttacattgctgaagcaaccgcttaatcttgtctattaaaaaataaaatcggaggaaatctaaatgattaaaattcttgctgcctgcggtgcaggtgttaactcaagtcaccaaattaaaagtgctctagaagaagaactttcaaaccgtggttatgatgttcactgtgatgcagtcatggtgaaagatgtaaacgaagaccttatgaaaggttacgatatctttacaccaatcgctgcaacagatcttggttttgaaccaggtatcccagttatcgaagctgggccaatcttattccgtataccagcaatgagcgctccagtatttgacaatattagactccctgcgaaacaaaatatggtatagtagttctatgaatgatgaagcaagtaaacaactaactgatgcacgatttaagcgtcttgttggtgttcagcgtaccacttttgaagagatgttagctgtattaaaaacag

SEQ ID NO: 43 - DNA, 874 bp; single-stranded, linear
cttcatcctgccatacggtcggtaattgacctgctgacatccgaaacctcccttaaatcgcattcttgtcaaaaccgagtttgcgttgaataaacttagcgatttcgacgatgataatcattgagaagcttccagccataacaattccccattgtgacaagtctagtttggttacgtggaaaattccttcaagcggttctacaacgattgtcgccatgagaaggataaaggataccaccatggaccagttaaaggtcttatacttgaatgggctagtgatggacttagaataggtgatttggagcgtcctattggctaggaaatgctgatcatagtcctttgctgaggctagggtgtttcaacattcaacactcaactggttgatctagttgataggaagggaattactataaaatactcaggcttccatcatattttttgaaacgattgtgtaatcaaaatgtaccaatattgtagtattagtacagaagatgttgtgaatggataaatatatcataactgctgtctcaaaaagatttcatatgtctgtgcatatataatagacttcctgcaaaactagaatcctagttcatgattgataataccagcaatcaaattcattcgtaatccaaagcgtttacgatgatttcgataggttgttgaaaacattttaaacgtttttactttggcaaagatgttctcaaccttgcttctttccttggatagcgcatggttacaggctttatcttcagctgttagcggcttgagtttgctggatttacgtggagtttgtgcttgaggatatatcttcatgggcccttgataatcactgtcagccaagattttaccagatctnnttttttaaaagggggcn

SEQ ID NO: 44 - DNA, 1461 bp; single-stranded, linear
cttcatcctgccatacggtcggtaattgatatgctgacatccgaaacctcccttaaatcgcattcttgtcaaaaccgagtttgcgttgaataaacttaacgatttcgacgatgataatcattgagaagcttccagccataacaattccccattgtgacaagtctagtttggttacgtggaagattccttcaagcggttctacaacgattgttgccatgagaaggataaaggataccaagatggaccagttaaaggtcttagacttgaatgggccaactgtcaagatggattggtagacagacttgacattgtaggcatggaagagctgaatcaaaccaagggttgcaaaggccatcgttagggcatctgcatgaatagcatgattgtcacccacatgaactgggtaagcaatcgcaaggccataaacactcataacaagagctgcttggagtacaccttgataaatgatagaactcaaaacaccacctgagaagaagcttgccttgcgtccacgtggtttatgattcatgacaccaggttctgcaggttcaacaccacagaacgatagctgggaaggtatccgttaccaagttgatccacaaaagatgaaccggctgtaagacatcccaaccaaacaaggttgataggaagatggttaatacttcagcagtattagcagaaagtaggtactgaatagtcttttgaatgtttgagaagaccttacgtccttcttccactgcgacgataatagtcgcaaagttatcatctgcaagaatcatatcagaagcccccttagaaacctctgtaccagtgattcccataccgataccgatatcggctgttttcagagctggcgcgtcattgacaccgtcacctgtcatggcaacgactttaccttgtttttgccaagccttgacgatacgaaccttgtgttctggagacacacgggcataaacagagtattgaccaacgactttttcaaattcttcatctgacagttcattgagttcagcaccagttaaaacgtgaccttctgtatcgtttgcgtcaatgattcccaaacgtttggcaatggcttccgctgtgtcttggtggtcacctgtaatcataattggacggattcccgcttccttagccacacgaacagcctcagcggcttcaggacgttcagggtcaatcatcccaatcaaaccagtaaaaattaaatcattttcaagctcttcagaagtgagattttctggaatactatcgataatcttataagcacctgcaaggacacgcaaggcttgatgagccatttcagaattgtttgtatgaatgagatttgtaaccttctcatcaatcggagcaatatccccagccttatcacgaaagaagacaacgttttaagagttggtctggcgcacccttgactgctacaaggaaacgaccatctggcaatgggtgaactgttgacatgag

SEQ ID NO: 45 - DNA, 2445 bp; single-stranded, linear
ctcccatcaagcttgcttcaagtttttctgtcaaggcttgcgcttcttcatccttgacattaacagtaatcaaatgcacatcaaatggtgccaattctttagggaaattgattccccaagcgtaacggtattcaccttttggcgttttgttaaacaaagaggcgagcgtgttgctccatcactgctgaaagaagacggctgacaccgataccgtaacatcccatgatgattggcacagcacgaccattttcatccaagacatctgctcccatgcttgctgaatagcgagttccgagtttgaaaatatgaccgatctcaataccacgcgcaaagttaaggacaccttgtccatctggggaaatttcaccctcacgaacttcacggatatccacatattctgcagtaaaatcacggcctgggttcacaccagtcaagtggtagccatcttcgttagcaccgacaactgcattgcgaacatcttgcaccttacgatctgcaataattttaatattctctggcaaaccaactggtccaagtgaaccaaatcctgcttgaacaacattcgccacttcttcttcgctagcaacgtcaaagaaatttgctcccaagtgatttttcaacttgacttcgttgagttggtcatttccaactagaagggctgcaacaagctcaccatctgcaatgtagaagagggttttaatcgtttgttcttctggaacattgaggaaggctgcaacttcatcaattgatttaacatctggcgtttcaacacgagtaacttcttcttcagcgacaacacggttgcttggtttgtactcgtttgttgccatttctaagttagctgcatagctagactcacttgagtaagcaatggtatcttcaccagagactatccatttgagcaattctgccttgatttcttcttgcacttctgcaggaatttcgtcaaatgaggcaactgacttgtccaagacaacccagcggtcaaggtctgtacgagcagatgtaatggccataaattcttggctatccttaccacccatggctccaccgtcaccaataatagccttgaagtctaaaccactacgagtgaaaatacgctcataggctgctttgtactcatcataaacactatccaaactatcatagttagcgtggaaactataagcatccttcatgataaactcacgtgtacgaagaagtccattacgtgggcgtttttcatcacgatacttgggctgaatttgataaaggttgagtggcaattgcttgtaagatttaacagaatcacggacaatagctgtaaaggtttcttcgtgagttggacctaagataaagtctgatttttcacggtttttcagtttgtaaaggtcttcaccataggtttcgtaacgacctgattcacgccacaattctgcactaagaagggctggagccaacatctcaacagcaccaatcttttcgaattcttggcgcatgatgtttttagctttttcaatcacacggttggcaagtggtagataagaataaacacctgctgaaacttggcgaacataaccagcacgcaacataagagcatggctgataacttgagcatcgcttggcatttcgcgaagcgttgggataggcattttactttgtttcataatattcctcgattatctaaaaaagagtcgcataatgtcattccaagtcacagcaatcatcaagacaaccatgatgaccactccggccaaggtgacataggtttcaatttcttgtttcaatggtttgcggcggatggcttctaggatattgagcacaatcttaccaccatccaaggctggaatcggaataagattaaaaatcccaatattgatggaaatcattgccaagaagtacaagaatattctcaattccatttttagcagcatcactacttgccttaaagatagcaacaggtccacccaacttgttcaaatccggttggaaaatcagatttttcagagactgaaaaaattccgaagagctgagttcagcagcagttgtaaaaccacctacaaacatggatagaaaatctgacttaacccccggttgaacacctagaaggtaacgaccttgactatcttcgggtgtaacagtgacttgtttgtcactccccttttcagaaatagtcacatccaaagtcggtgccgtcttatctttggtttctgtttccacagcttggatcaagctttcccagtcgccaacctcatgtgagccaaccttggcaatttgtgccgtttctggtactcctaccttgggccaagggcacccttggggggcatggattatggaacttggattggtatctaaccatctctgacaccaccctgcataaagattaaaacccaaaaaacaacaacacctaagataaaattgttcataggacctgcaaaattggtaatcagtttgccccagataaag

SEQ ID NO: 46 - DNA, 2207 bp; single-stranded, linear
ncaggctanctctcgtctgaatgaagatggaacctttgctgacaagattgtcatgggacgtcaccaaggggtcaaccaagagtatccagctaatattgttgactacatggacgtttcaccaaaacaggtagttgccgttgcgacagcatgtattcctttcttggaaaacgatgactccaaccgtgccctcatgggagccaatatgcaacgtcaggctgtgccattgattaatcctcaggcaccttacgttggtactggtatggaataccaagcagcccacgattctggtgcggctgtgattgctcagtatgatggtaaagttacttacgcagatgctgacaaggtagaagttcgtcgtgaagatggttcattggatgtttaccacatccaaaaattccgtcgttcaaactcaggtactgcttacaaccaacgcactctcgtaaaagttggtgatgtcgttgaaaaaggcgatttcatcgctgacggaccttctatggaaaatggagaaatggcgcttggacaaaacccaatcgttgcctacatgacttgggaaggttacaacttcgaggatgccgttatcatgagcgaacgcttggtgaaggacgatgtctacacatctgttcaccttgaagaatacgaatcagaaacgcgcgatacaaagcttgggcctgaagaaatcactcgatcgaaattccaaacgttggtgaagatgccctcaaagaccttgacgaaatggggattatccgtattggtgctgaggttaaagaaggtgatattcttgtaggtaaagtaacacctaagggtgagaaagatctttcagctggaagaacgtctcttgcacgctatctttggagacaagtctcgtgaagtgcgtgatacttctcttcgtgtaccacacggtgccgatggtgtcgttcgtgatgttaagatctttacacgtgtaaatggagatgagttgcaatcaggtgttaacatgttggttcgtgtttacatcgctcaaaaacgtaagattaaggtcggagataaaatggccggacgtcacggaaacaaaggggttgtctctcgtatcgttcctgtagaagacatgccttaccttccagacggaactccagtcgacatcatgttgaacccacttggggtgccatcacgtatgaatatcggtcaggttatggagcctcaccttggtatggcagctcgtactcttggtattcacattgcgacaccagtctttgatggagcaagtcctgaagatctttggtcaactgttaaagaagcaggtatggatagcgatgccaagacaatcctttacgatggacgtacaggtgaaccatttgataaccgtgtttctgttggagtcatgtacatgatcaaactccaccacatggttgacnataaattgcacgcgcgttcagtcggaccttattcaactgttacccaacaaccactcggaggtaaagctcagtttggtggacaacgtttcggtgagatggaggtttgggctcttgaagcctacggtgcgtcaaatgtccttcaagaaatcttgacttacaagtctgacnatatcaacgggacgtttgaaagcctatgaagctattacaaaaggcaaaccaattccaaaaccaggtgttccagaatccttccgagttcttgtcaaagaattgcaatctcttggtcttgacatgcgtgtcctagacgaagatgaccaagaagtggaacttcgcgacttggatgaaggaatggacgaagatgtcatccacgtagatgaccttgaaaaagcccgcgaaaaagcagcccaagaggctaaagcagcctttgaagctgaagaagctgagaaagcaacaaaagcggaagcaacagaagaagctgctgaacaagaataagcagttcacttagaatagaaagggaagaaatagtggttgatgtaaatcgttttaaaagtatgcaaatcaccctagcttctccaagtaaagtccgttcatggtcttatggagaagtcaaaaaacctgaaacaatcaattaccgtaccttgaaaccagaacgtgaaggactctttgatgaagtgatctttggtcctacaaaagactgggaatgtgcttgtggtaagtacaaacgcattcgttacagaggaattgtttgtgaccgctgtggggttgaagtaacgcgtacgaaagttcgtcgtgagcgtatgggacatatcgaattgaaag

SEQ ID NO: 47 - DNA, 2339 bp; single-stranded, linear
cgactgaaatgggtgaattgtactcttggcttggtttgtcagtagggattaacttggctaccaaatctccaatggagaaaaaagaagcctatgagtgtgatattacttactcaactaactcagaaatcggatttgactaccttcgtgacaatatggtcgttcgcgctgaaaacatggtacaacgtccgcttaactatgccttggtcgatgaggttgactctatcttgattgacgaggctcgtacacctttgattgtatcaggtgccaatgcggttgaaaccagtcagttgtatcacatggcagaccactatgtaaaatctttgaacaaagatgactacatcatcgatgtgcagtctaagactattggtttgtctgattcagggattgacagggctgaaagctacttcaaacttgaaaacctctatgacatcgaaaacgtggctttgacccactttatcgataacgcccttcgtgccaactacatcatgcttctcgatattgactatgtggtgagcgaagagcaagaaatcttgattgtcgaccaatttacaggtcgtaccatggaaggtcgtcgttattctgatggattgcaccaagctattgaagccaaagaaggtgtgccaatccaggatgaaaccaagacatctgcctcaatcacgtaccaaaaccttttccgtatgtacaaaaaattgtctggtatgacgggtacaggtaagactgaggaagaagaatttcgtgaaatctacaacattcgtgttattccaatcccaacaaaccgtcctgttcaacgtattgaccactcagaccttctttatgcaagtatcgaatctaagtttaaagcggttgtcgaagacgttaaggctcgttaccaaaagggtcaacctgtcttggttggtacagtagcggttgaaactagtgactacatttctaagaaattggttgcagctggtgttcctcacgaagtcttgaatgccaaaaaccactatagagaagcccaaatcatcatgaatgctggtcaacgtggtgccgttaccatcgcaaccaacatggcgggtcgtggtaccgacatcaagcttggtgaaggtgttcgtgaacttggaggactttgtgttattggtaccagaacgtcatgaaagtcgtcgtatcgataaccagcttcgtggacgttcaggtcgtcaaggagatccaggtgagtcacaattctacctatctcttgaagatgatttgatgaaacgttttggttctgaacgcttgaagggaatctttgaacgcttgaacatgtctgaagaggccattgagtctcgcatgttgacgcgtcaggttgaagcagctcagaaacgtgtcgaaggaaataactacgatacccgtaaacaagtccttcaatacgatgatgtcatgcgtgaacaacgtgagattatctatgctcaacgttacgatgtcatcactgcagatcgtgacttggcacctgaaattcagtctatgattaagcgcacgattgaacgtgtcgttgatggtcatgcgcgtgccaaacaagatgaaaaactagaggcaattttgaactttgctaagtacaacttgcttcctgaagattctattacgatggaagacttgtcaggcttgtctgataaggccatcaaggaagagcttttccaacgtgccttgaaggtttacgatagtcaggtttcaaaactacgcgatgaagaagcagttaaagaattccaaaaagttttgattctacgagtggtggataacaagtggacagatcatatcgatgcccttgatcaattgcgtaacgcggttggacttcgtggctatgctcagaacaaccctgttgttgagtatcaggcagaaggtttccgtatgtttaatgatatgattggttcgattgagtttgatgtgacacgcttgatgatgaaagcacaaattcatgaacaagaaagaccacaggcagaacgtcatatcagtacaacagcgactcgcaatatcgctgctcaccaagcaagtatgctagaagatttggatttgagccagattggacgcaatgaactttgcccatgtggttctggtaagaaatttaaaaactgtcacggtaaaagacaataaaatgagatagtttagaggcggatatcttgtgaaaagtaaatttttactgggtatccgtttgctttataaggagatgagttatggtatttacagcaaaaagctctaaaataaatatagaagaagttcgtgccttgtcaaaattagaaggtcaggctttggagaggaaatcacagcgagatcaagagctagaagccattatacgtggagaagaccagcgaattctcttggtaatcggg

SEQ ID NO: 48 - DNA, 642 bp; single-stranded, linear
ttaatnggtactttggcgagnccttttaggnaaaatggtatcnatggccntgatctagttttggtatcgcttactttatggctagacaatacaaagttgatggtattcctgctggtattgtgtcattatcatcttttattacagttacgcctttcattacaggagaggctggagcaggaatgcctaccgctttcatggcatcaaaaggtttatttgttgctatgattttaggattgattaatggctatatctaccaatggtttataaatcataatatacagataaaaatgccggatggtgttccaccagcagtatctaaaagctttagtgccattattcctggtgcagtgactattgttggttggttgattgtttatgcaactttagataaattaagtttacctaatcttcatgaaattgctcaagttagctttgggaggtccacttggacttttaggaaataatgttattggtcttcttatcttaattttccttaatagtagtttttggtttgtaggattacacggaggaaatgttgttaatgcagttatgaaaccgttatggttagctaatctagatgcaaataaagtacncgcccncccgggggaatcccnctatttcntaaacgggcccccccccgng

SEQ ID NO: 49 - DNA, 1460 bp; single-stranded, linear
cttactttgcagaaattttccgtgggggattgacactattccaagaggacagtatgaggctgccaaggtcttgaagtttagcccttttgacagagtgcgctatattatcttgccccaagtgaccaagatcgttcttcctagtgtctttaatgaagttatgagtttggtcaaggatacttctttggtctacgctctcggaatttcagaccttatcttggctagtcnaacagctgctaaccgcgatgctagtctggttcctatgttcttggcaggagctatttacttgattttaattgggattgtgacaattatttccaaaaaagttgagaaaaagtacagttattatagatagggggcaggattcgatctatgttagaattacgaaatatcaataaagtctttggagacaaacaaatcctgtctgatttcagtctaagtattcctgaaaagcaaatcctggctatcgttggaccttctggtggaagtaagacaactcttttacgtatgcttgcgggtcttgaaaccattgattcagggcaaatcttttataatggacaacctttagagctggatgaattgcagaagcgcaacctactgggatttgtcttccaagattttcaactatttcctcatctatcagttctggaaaatttgactttatcgcctgtgaagaccatgggaatgaagcaggaagaggctgagaagaaggcgagtggactcttggaacagttaggactaggaggacacgcagagtcctatcctttctcactatctggtgggcaaaagcagcgggtggctttggcgcgtgctatgatgattgacccagaaatcattggctacgatgaaccaacttctgccctggatccagaattacgtttggaagtggagaagctaatcttgcaaaatagggaacttgggatgacccagattgtggttacccatgatttgcagtttgctgaaaatatcgccatgtattattgaaagtagaacctaaataggaggaaaaatggatgaaaaaatggatgcttgtattagtcagtctgatgactgctttgttcttagtagcttgtgggaaaaattctagcgaaactagtggagataattggtcaaagtaccagtctaacaagtctattactattggatttgatagtacttttagttcccaatgggatttgctcagaaagatggttcttatgcaggatttgatattgatttaaaaacanctcttnttgnnaaatacggaatcacggtaaattggcaaccgattgattgggatttgaaagaagctgaattgacaaaaggaacgattgatctgatttgggatggctattccgctacagacgaacnccgtganaaggtggctttcagtaactcatatatgaagaatgagcaggtattggttacgaagaaatcatctggtatcacgactncaaaggatatgactggaaagacatnaggag

SEQ ID NO: 50 - DNA, 1323 bp; single-stranded, linear
ctgctatcttcatcgtttcaatcaataccggtgcctacatgactgaaatcgtccgtggtggtatcctggcagttgacaagggacaatttgaagctgcgactgctcttggtatgactcataaccaaaccatgtgtaagattgtcctacctcaggttgtccgcaatatcctaccagcaactggtaatgaatttgtcatcaatatcaaagatacatctgtattgaacgttatatctgttgtcgagctttatttctcaggaaataccgtggcgacgcaaacctatcaatacttccagacatttacaatcatcgccgtgatttactttgtcctcaccttcaccgtaacacgtatcctacgctttatcgagcgcagaatggacatggatacctatactacaggtgctaaccaaatgcaaacggaggatttgaaataatgacacaagcaatccttgaaattaaacacctcaaaaaatcctatggacaaaacgaagtgctaaaagacatttctctcactgtccacaagggagaagttatctctatcatcggaagctctggaagtgggaaatcgaccttcctacgctccattaacctacttgaaacgccaactgatggacaaatcctttatcatggacaaaacgtcctcgaaaaaggctatgacctcacgcaataccgtgaaaagttagggatggttttccaatcctttaacctctttgaaaatctcaacgttcttgaaaacacaatcgtcgctcagacaactgtccttaaacgcgaacgcacagaagctgaagaaattgccaaagaaaacctggaaaaggtcggcatgggagaacgctactggcaattgccaaaccaaatagcaactatcaggtggtcaaaaacaacgtgtggccatcgctcgtgccctatcaatgaatccagacatctatgctctttgatgaaccaacttctgcccttgaccctgagatggttggagaagtaattaacgttatgaaggaattggctgagcaaggcatgaccatgattatcgtaacccatgagatgggatttgcccgccaggttgccaaccgcgttatctttactgcagatggcgagttccttgaagacggaacacctgaccaaatctttgataacccacaacaccctcgtctgaaagagttcttagataaggtcttaaacgtctaaactcaaactgcaaggatttccttgcagtttttctacctcgtattggaatttttgatttttcggaaaattatgttagaattaagtttatgaaatgaggtttcctcatacctagcaagactaggaataaaaatagaaattaggtag

SEQ ID NO: 51 - DNA, 2469 bp; single-stranded, linear
ctcttcaaattcttcacgagtacggaagaaatagtcaacaccgtccacttctccaggacgttgtgcgcgtgtcgtcatcgatacagaatattgaaattggttttcagaactctcaaaaatctctcttctaaccgttccttttccaacccctgaaggaccagaaaaaacgattagtaagcctcggtctgccattgtgtctccttttagtcaatctgtgaaataacatttctctagaataatggcaaaaagccagattatcctttacagtctttctatatagtgtaacaaaaaagcagtaatttttcaactgctctttcttatttatttagcataatctactgcacgaagctcgcgaatcacggttaccttgatatttcctggataatcgagattgttttcaattttcttacgaactttgtgagccaagattgtgactttgtcgtccttgatttttcctggattgaccatgatacgaatttcacgtcctgcttgaagggcaaagctagtttgcactccttcaaagccgttagcaatttcttccaaatcatggagacgcttgatgtagctttcaagagactcactacgagcacctggacgggctgcgctcaaggcatctgctgcagcgacgataactgctatcacgctctcagcttcaacatctccgtggtgactagcaatcgtattcaccacaactgggggttccttgtacttacgggccaattccataccgatttcaacgtggctaccttcaacctcatggtcaatggctttcccgatatcgtgaaggaatccagcacgacgggcaagagccgcattttcaccaagttcgctcgccatgataccagccaacttagcaacctcaatcgaatggcgcaaaacattttgtccatatgaagtacggaactgcaaacgtcccataatcttcatcaagtctggatgaaggtttggcgcaccaatttcataggcagcagcctcaccgtattcacgaatcttattgtcaatctcttgacggtttttctcaaccaactcttcgatacgagctggatgtatacgaccatctttgagcaacatttccatagtcatacgggcaatctcacgacgaatcggatcaaatcctgacaaggtcaccacttctggtgtatcgtcgataatcacatcgacccctgtcaaactttcaaaggtacgaatgttacgaccttcacgaccaataatgcgtcccttcatagtatcgtctggcagatgaactgttgagtttgttgactccgctacatattcaccagcgatacgttgcatagcttgaaccaagatgtccttggccattttgtcagaacgttccttgacctcttgctcagcttcgcgaatgcggactggcaatctccctggtcaaggtttcctctgtcggagccaagataatatctcgtgcttctgcctgagacagagcaccaatacgctctagttctgcgtcttttggtctttcgacttcctctaattgctcttcacgcgcatcaaggtttttcgctctatcagaaaatactttgttcttttctgttcaagtgtttgttctttactcgtcaaattgtcgtccttacggtcaaggctagtagctctctctgtcaaacgactttcgatttgtttgagttcttgacgttctgatttgaattcagcgtccacttcttcacggtattttctggcttcttctttggcctccaatagtgcttcttttttaagagacttgctttcacgtttggcttcattaacaagtaaatccgcttcacgctcagcttgtccacgtaaattagttgcttcttgttcagcatttaaaagcatcaactctgcagcttcctgagatgatttcatcttagctgagatgctgacatatcccaatgactaaaccaatgatgacggcaaaaacagcaatcgcaagcgacatgatttccatgtttttacctcattttattgttattccgaatgacatacattcttttacattctaccataaaaaagtgattttcacaaacctaaaatagaatatgttttggggaaattggagtttaaatgcctataatttattggcacaatctctatttcttagaaatcgtggtttagtaaagatttgagaaaaagcctacttttcagtagacttcctaataatcgttagaatgcaagaaatttgtttctaacaacagcaagatttcactcaggtattctctgtaaattagactagtgtcctgcacgaattttatccattcctcgcaaaaccttgtctgataactccttattttgggcgattctcagggtttcctgaatactgtcccattcgctctttgaaagaactacaatgtcctcatctggatttttattgaccaccgtcaaaggctcaaatttatcatttaccttcttcatgtagtcctttaaatgatttcggaatgttgagtaaaggactgcttccataaccacacctcgttttag

SEQ ID NO: 52 - DNA, 1828 bp; single-stranded, linear
ctattcatgtaagcattcgtcccgaagagtttatcaaagatgaatctggagatattgaaggaactattagcgatagcgtctatcttggactaaatacggagtatttcattgagacaggttttgcctcaaaaattcaagttagtgaagaatcaacttttgaagaagaactacaaaaaggcaatcgtattcgtctacgaatcaatacgcaaaaattaaacatcttttctgcagatggttcccaaaacctgataaaaggagtcaaccatggaacgtaaaaaactaaatatttggacagcctcctctttcttcatctttcttacctatcttgtctttctcgtttatcctatcgttaccgtgctcaagtaagcacttatacatgaaggataattctcactagctaattttgtcactttctttagtaaagcctactactctgagacactagtcaacagtttcagggtttccattaccgctactgtcacttccttagttgtaggaaccctattagcttatctcttctctatgtatgacttcaaggggaagaaatttctacaaatattgattatcattgcttccatgtcaactcctttcgtaggagcctactcctggattctcttgctgggacgaaatgaggtcatcactaaatttttgacaaatgccctttatcttccagctatcgatatttatggattcaaaggaattatacttgtctttacactgcaactattcccactggtatttctatatgttgctggaacaatgaacagtattgacaattctctacttgaagcagctgaaagcatggggtccttcggatttaaacctatcgtaacggttgttttacctctcctagttccaaccttactagcagctccttgcttgtatttatgagagcattctcagactttggaacgcctatgttgattggcgaaggatatcggactttccctgtcctgatttatacccaatttattagcgaggttggaggaaattctgcttttgcaattatggcgattatcattgccttggcaattttccttatccaaaaacacattgcaaaccgctacagtttcagcatgaatctgctccatccaattgagcctaaaaaaactacaaaaggaaaaatggctgccatttatgcaacagtctacggaattatctttatctctgttttacctcaaatctacttaatttatacctctttcctaaaaacatcaggtatggtatttgttaaaggttattctccaaacagttacaaggtagctttcaatcgtatgggatctgctattttcaataccattcgtatccctttgattgccttagttctagttgttcctatttacgacatttatctcctacctagccgttagaaaacggaatttgtttacaaacttaattgacagcctcagtatggtaccttatattgtaccaggaaccgttctagggattgccttcatttcttccttcaatactggtctatttggaagtggatttcttatgattacagggactgctttcatcttgattatgtctctatctgtcagaagattaccgtatactattcgctcatctgttgctagcttacaacaaatagcaccaagtattgaagaagctgctgaaagcttaggaagtagtcgtctcaatacctttgctaagattacaactccaatgatgctatctggtatcatttctggagccatcttatcttgggtcacaatgatttcaaaactctctacttctatcctcctctacaatgtcaaaacaagaacaatgactgtagatcaagcttatngatacggtcgacctcgaggggngcccgggcccaatg

SEQ ID NO: 53 - DNA, 1176 bp; single-stranded, linear
ctaaactttcgctcataggcatacaaattaatcctttggcataagtagccataaaattaacattttctgttgtagctgcttgtgcagaacaaattaagtctccttcattttctctatccttgtcgtctataacaagaacaagtcgtcccttctgcaatgcttctaatgcttcttgtatttttcgatattccattgactgattatcctttctgctaaaatccattttgatataatagttccttcgatatttctgattttggagagttatccatcagtttttgcacatatttacctaagatatcattttcaagatttactgtactcccgacttgtttactcttaagaatggtttgtttcaaggtatgagggataacagatactgaaaagtttactttggagactttagcgacagtcagactaatgccgtcaattgtaatagatcctttttcaactattaaatctaaaatttctttttgtgtgttgatttgataccatacagcattatcatctttttttattgacgagatttttcctgtaccatcaatgtgtcctgtaacgacgtgacccccaagtcgaccgttgacagataaggctctttctagattcacctcacttccatgttttaatagagtaagagagctgttcgactccatgtttcattcattacatcaactgtaaaggattgatgattgaaatgagtaactgtaagacagataccatttactgctatactatcgcctaaatggatatccgttaatatttttgaggctttaattgatagtttacaattacgagagtctttctgtattctttcaacttttccgatttcttcaattattcctgtgaacatggataaatcacttcactttctatgagatagtcatttcctatttgagaaaaagcataaggtttcaatctaatagcgtcatttggcaaagaaatgccttcacctccgacaggaaacttggcactgcctccaaaaatttttggtgcaatatatattttcagctcatcaacaatttgttgttccaaagcactccaattcattagactgcccccctctagaactaggctatcaatctgcatgtttcctagatgttgcattaaactcgataagtctatatgattgccttttttctttatgggaagtatttcacagccatgattttgatatag

SEQ ID NO: 54 - DNA, 1449 bp; single-stranded, linear
ctatcgataacatggatgcagacgttatttcctttgaagctagccgttcaaaccttgaaatcttggacgaactcaaagcgaaaaacttccaaacagaagtgggacctggggtttacgatatccactcacctcgtgtaccaaatgaaggcgaaatcgacaacacaatcgaagccatccttgctaaagtgccaagcaagaaagtttggatcaaccctgactgtggtttgaaaacacgtggtatcccagaaacaaaagaaagcttgatccgccttgttgaagcagctaaagctgcgcgtgagaaattgtaagattggatttctctccatacagtggttgttcaaaaagaaatcaactagaaaaggttattacatatgtcacgccaaacaccgtcactctcatttgaagtgttccctccaaacccagccgtgggtaatgataacattatttcagccttgcaggatatgcaggagttggctccccattttatcagtgtaactgccagcaataataaatttaatatcaaggaaacgacggttcgtttggctgactttatccaaaatgatttggcgattccgaccattgcccacttgccagctatttatctaactaaggacaaggttgctgaaactattgctgacttggacaaagttggggtgcagaaaatcttggctcttcgtggggatattattccagacgtggaaccacaaaaggatttccgctatgcaaccgacttgattgagtttatcaaggaacaaacccctcactttgatattattggagcttgctatccagaagggcatccagattcgccaaatcagatttcagatattcaaaatcttaagaagaaagtggatgcaggctgttcgagcctcgtaactcagctcttctttgacaatgagcgcttctatgattttcaggacaagtgtattttggctgggattgatgttcccattcatgcaggaattatgccaattctgaatcgaaatcaggctctccgactcttgaagacttgtgagaatatccatcttccacgcaaatttaaagccatcttagacaagtatgagcatgaccctgagtcgctcagagcagcaggacttgcctatgcagtggaccaaatcgtggacttggtaactcaggatgttgccggtgtgcatctctatacgatgaataatgctgatacagcaaaatacatccatcaagcaacccatgccttgtttaatcaccagtctctaggataataaaagcaaaccattcttctcaggtgaggggaatggttcctttttaatggcaaagacctcactttttaagaaaaatatgataaaatagattctgtacgtacttgatacaaagatgaaggtattaaataatacaatgcatttaaactgtaagatttaacgacacgagtgagtcaaatcgatgttatttgacgaaagagttagtaaagcattt

SEQ ID NO: 55 - DNA, 1343 bp; single-stranded, linear
ctcggtttccttttcacgattaagctcgttgtagagtttttttagcacacggttcatcttgagattttcttgctccacctcacggatattgtccaagcgtttgcggctttccagcgtctgctcttctagttgctcaatgatacgattgacgtcattgtcctgatcgatctgctgactggcatctcctacgataacttcagataggcctagacgtttggcaatttcaaaggcattacttcggccaggaacaccctgcataaagcgataggtcgggcgaagagttgcagtatcaaactccatactggcattttgcacaaaggctgtctcaataccgtaggccttgagttctggatagtgggtcgtcgccatggtcttgatttgacgcaggcgaaggtcctccagaatagccatggcaagggctgctccctcttggggatcagtaccagcccccaactcatccaaaagtaagagtgaatgttggttgaccttgccaagaatatccacgatattggtcatatggctagagaaggtagacaagctctgctcaatagactgctcatctccaatatcagcaaagatttcttcaaaaataccaacacgacttcccttgtctgctaaaatcggcaatcctgactgggccatgacctgtgtcaagcccagagttttgagcatgatggtcttcccacctgtattgggacctgtaatgacaatagcctgttaaatcttgaccaaaatagacatcatttgcgacggcatttttgaccaaaggatggcagacatggagcagttgaatctcttgattttctgacagctgaggcacgactgcttgtctttcttggataaatcgaaccttggcacgaatcaagtccagatgaccgataatccaagcgtcattagcaatctcagccgcatgagggcggacacgctcagaaatttcttggagaatgcgaagcatttcatagcgctcatctgctcgcagactagcaatttcttcgctcagtttgactacctcacgtggttcgatatagacggtgtttccactagcagaaatatcatgaacgacacctgcaatcttattgcggtaggtgtttttgactggtaaaacctgacggccatttctgctagcaacaattccttccgtcaacatctgcgctttttgcttgagcaagtcttgtaaaacatcgcgtacctgactctcgctatcatgtatttttcgacggattcgcgccaattcttcactggcaaaattttcaatgaaacccgcatcattaaaggcctgaagatttccttgtaattgcggaaaatcatgtaatttctcaaaccaaagggctaattcttccaag

SEQ ID NO: 56 - DNA, 1620 bp; single-stranded, linear
ccgatctcttttacagaggtgtttcctattttgtgcttccatttttggggcaaggaattgtagatggggatggcaatcctatctttttattgattatgatattcgtttgcttcatagttttagtctttttgaaatggttagactatgatttcactagattgagaagggagtttctagatacaggttttcaaaagtctcttactaagattaactgggcaatgggggcttattatctagtgatgcaaagtctatcttaccttgaatatgaacaaggtattcaatcaacgactgttcgccatctcatcctagtgttttacctactcttttttatggggggtatcaagaaattggatacctatttgaaggaaaaacttcaggaggaactgaaccaagagcagaccttgcgctacagagatatggaacgctatagtcggcatatagaggaactttacaaggaaattcggagttttcgccatgactacactaacctcttaaccagttacgtttgggcattgaagaggaggatatggagcagataaaagagatctacgactcggtcttaagggattccagtcagaaattgcaggacaataaatatgacctgggcagattggtgaatattcgtgaccgtgccctcaagagtctcctagctggaaaatttataaaagctagagaaaagaacattgtctttaatgttgaagttccctgaggagattcaaggttgaggggatgagcctacttgattttctaaccattgtgtctatcctttgtgacaatgctattaaagctagtgcagaggccagtcaacctcatgtttcaatcgcctttttaaaaaatggagcacaggagacttttatcattgaaaactccatcaaagaagagggcatcgatatttctgaaatcttctcctttggagcaagttctaaaggggaggagagaggagttggtctctataccgttatgaaaattgtggaaagtcatcccaataccaatctaaatactacctgccaaaatcaagtctttcgtcaggtacttactgtgatacatgcagaatgataaaaaacaagaccgagagttcttgtttctcggtcttgtttttatagctgaataggtagttcaagtgcttttgtgattttaaatttacttaaaattgtttcatgtaagagttcttcccaccattctccacctgtaatttggttgagttcggtagttgttagttcttgaaatgaagttaggttttgtttcttatccatgttatgattctcctttttgataagataataaatagttatagagtgttatctgaaaattaatcagaatgggttaaaattttatctttgaaataatcaaaatatgttttctttgcagttacactagtgacgcgaccttgtaagccatattggatgagtttactatcctcatttagatagttttgcaagcagcggttaatttaaagagattgccttgctctgttctggtaggagtttgatcaattgtctgaagttggccgatgatggtaatgccgtgatttccaatcttctccagcttttaatctcacagttttgtcctttatcttagttacaggtagatagtccagaagctacgtagtaagtgattagt

SEQ ID NO: 57 - DNA, 788 bp; single-stranded, linear
ctgatttcccttggcaatctaaaaatgaatcatagtagtcatgaagttcaaataggagaaaaaatgctggatttaactgttaaatcatttgaattgctgtggattttagctagcaatccagagcgagttttctccaagacagacctctatgaaaagatctggaaagaagactacgtggatgacaccaataccttgaatgtgcatatccatgctcttcgacaggagctggcaaaatatagtagtgaccaaacgcccactattaagacagtttgggggttgggatataagatagagaaaccgagaggacaaacatgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtagcggccaaggattttccttcaaatttggaggttcaaggtcctgtagaatttcagcaattagggcaaacttttaatgagatgtcccatgatttgcaggtaagctttgattccttggaagaaagcgaacgagaaaagggcttgatgattgcccagttgtcgcatgatattaagacccctatcacttcgatccaagcgacggtagaagggattttggatgggattatcaaggagtcggagcaagctcattactac

SEQ ID NO: 58 - DNA, 1588 bp; single-stranded, linear
ctgactatcaaaaaagaccattttcttctttttctcatcgataatacgagaatattttcggaaattagaggtcggctgaataataaagccgtctactcccaagagaagcatgctttcaatataccggtcctcactctcttggctgtaattactatttcctatcattacctggtagccattctggctggcgatatcctcaattcccttaacaatttggtttgagaaactgttggtaatatcaccgatcaaaacaccgattaattttgttcgtttggagttttaagctacgcgcaacaatgctcggtttgtaatttgtttcatgaataactttttcaatcttttcacgtgtctcttgggacattttttcatatttcccgtttaggtaaaatgacacggttgttttcgaggtctgagccatttccgcaatgtcttttatggtcagtttcttctccaatctaaaacacctcctactaatacttattataacatattcactattcaaaatgcttatttctagcactgcaagcgaatcattctctcatttattttatcatatactagacattttccacgcatttttgttccgtcaacgaggcacaatttttcacctacaccaatatcctcgcttaataacagaatcagcttgtctgtttcgtcatttttcacttcaaaagccagagcattttccacttcacgatcatctgtctggtagacagaatgacggatgatttcaaaactctcatgcgcaatgatggtataatccagcatctgattctcaaagaattggcgcttggtgagtttgctacttctttcaagctcattgtatttaggagaaatgatggtatcttccaaatcaaaatcaacttcactccatagtctcaactgattgattttcccatcttgataggtcacatccttgtcaaggataaactgagtcaacgcctcatgctgaccttgacacctgatgtcatctaccaagagccagacatcctctaccaacatgaggatttttctcttgtgaagataaggcaaatcaggttctgctgaccaataagccccttcaatataatgcattccctccctttctttatggtgacaaaacagggagtgaggatagtattcatattcccaggatcccgtgattctttccggagctttcccatctacaatgcaggtcgaatgactccaagcactctttaagagataacgttcatatatctcccgataagaataacgcccagcatctatgaaaataggttggccttgatactgtaagcaaaaactattctcgtcactatggctatgggcacttcctagcggaccatttttgaaaaatagataacgatgttcatccttaatgcagacatgtccagagtcttcaaagatcatggacttaggctgccaagctctcttttcaaattcctgcagtcgcttgatcttttctcgccccaggaacaagaggctaacctaatcgactttaacatccaaaccgttaagaaggtctcccttgttcaaaaccacagcagacaggctcaagttatctgtcgtgtctgttgaatcgctatcaccaatttcccatagttcgtcc

SEQ ID NO: 59 - DNA, 1551 bp; single-stranded, linear
ntcttgggcncngggcgnntcctttgaggacnacggtatcgatgaccttgatctcaagtgcaagcagtatctgaatctgcagcagcacctgtccgtgcaaaagttcgtccaacatacagtacaaacgcttcaagttatccaattggagaatgtacatggggagtaaaaacattggcaccttgggctggagactactggggtaatggagcacagtgggctacaagtgcagcagcagcaggtttccgtacaggttcaacacctcaagttggagcaattgcatgttggaatgatggtggatatggtcacgtagcggttgttacagctgttgaatcaacaacacgtatccaagtatcagaatcaaattatgcaggtaatcgtacaattggaaatcaccgtggatggttcaatccaacaacaacttctgaaggttttgttacatatatttatgcagattaatttacagagggactcgaatagagccctcttttcaggttttaccgtgacaatccctattaaaaattatatcaaaatcgtgaaaatattggaaaagtatggtagaatgaaaattgtcgtgtgaacgataatactcattcttgatgaattgtgaagcagttgcccttgggtcgttttgcgagttgaagtcaagaagaggaaaaaaacaaaaaggagaaatactcatggcagtaatttcaatgaaacaacttcttgaggctggtgtacactttggtcaccaaactcgtcgctggaatcctaagatggctaagtacatctttactgaacgtaacggaatccacgttatcgacttgcaacaaactgtaaaatacgctgaccaagcatacnacttcatgcgtgatgcagcagctaacgatgcagttgtattgttcgttggtactaagaaacaagcagctgatgcagttgctgaagaagcagtacgttcaggtcaatacttcatcaaccaccgttggttgggtggaactcttacaaactggggaacaatccaaaaacgtatcgctcgtttgaaagaaattaaacgtatggaagaagatggaactttcgaagttcttcctaagaaagaagttgcacttcttaacaaacaacgtgcgcgtcttgaaaaattcttgggcggtatcgaagatatgcctcgtatcccagatgtgatgtacgtagttgacccacataaagagcaaatcgctgttaaagaagctaaaaaattgggaatcccagttgtagcgatggttgacaccaatactgatccagatgatatcgatgtaatcatcccagctaacgatgacgctatccgtgctgttaaattgatcacagctaaattggctgacgctattatcgaaggacgtcaaggtgaggatgcagtagcagttgaagcagaatttgcagctccagaaactcaagcagattcaattgaagaaatcgttgaagttgtagaaggtgacaacgcttaatttatacaaatagtaattacctaggagggcggggcttagcccggctctcctattttcaaaaaatataggagaattaaaatggcagaaattacag

SEQ ID NO: 60 - DNA, 1007 bp; single-stranded, linear
ctatatttctgactatcctaaaaacaatggtgaagcaactagtccagcagccgggaataatacaggttctaaatacccttatactattgatgtgacaggcgaggttggtgatttgaaacaaggtttttctgtcaacattgaggttaaaagcaaaactaaggctattcttgttcctgttagcagtctagtaatggatgatagtaaaaattatgtctggattgtggatgaacaacaaaaggctaaaaaagttgaggtttcattgggaaatgctgacgcagaaaatcaagaaatcacttctggtttaacgaacggtgctaaggtcatcagtaatccaacatcttccttggaagaaggaaaagaggtgaaggctgatgaagcaactaattagtctaaaaaatatcttcagaagttaccgtaatggtgaccaagaactgcaggttctcaaaaatatcaatctagaagtgaatgagggtgaatttgtagccatcatgggaccatctgggtctggtaagtccactctgatgaatacgattggcatgttggatacaccaaccagtggagaatattatcttgaaggtcaagaagtggctgggcttggtgaaaaacaactagctaaggtccgtaaccaacaaatcggttttgtctttcagcagttctttcttctatcgaagctcaatgctctgcaaaatgtaaaattgcccttgatttacgcaggagtttcgtcttcaaaacgtcgcaagttggctgaggaatatttagacaaggttgaattgatagaacgtagtcaccatttaccttcagaattatctggtggtcaaaagcaacgtgtagccattgcgcgcgccttggtaaacaatccttctattatcctagcggatgaaccgacaggagccttggataccaaaacaggtaaccaaattatgcaattattggttgatttgaataaagaaaggaaaaaccattatcatggtaacgcatgaagcctgagattgctgcctatgccaaac

SEQ ID NO: 61 - DNA, 1591 bp; single-stranded, linear
ctcgccagagaactcatccacatagatattgccaagtccagctaccaaggtctggtctaggagatgggatttgataggctttttggacttggcaagggcagcttgaaagacctgtaaatcaaagtcttgttcgcttggttcaggacctaattttttagaaataaagtaggcgtctaaaaggtcaggcaccaagagttccatggttccaaacttgcgtacatcctcataaacaagcgtgcccccatcttcaaaccggaagaaaacatgggcatgcttgcgttcaggcacttggtctggataataaaaatacttgccctccatccgcaaatgggaaatcaagaccttgtctgtcaggcagaaaagcaaatattttccacgacgtcccattgactcgataatctgactaggcaattccctttgaaactcttccaaatccgtcttaatcatcttggggtagcgaatttctatactcgaaatcttctttcctataatcaatttttctaagctacgacaaacggtttcaacctcaggtaattcaggcataagtcctccttctgtaaaaacaagaagcaggcatgagcctacctctacttagtattctctttcattatagcccaagtcagccaaatctagctttttatcgcgccagtttttcttgaccttgacccaggtttctaggaagaccttgtctcctagcatgagttcgatatcacgacgggccatgctaccgattttcttaagcatagcgccacctttaccgatgataatccctttttggctatcgcgctcgaccatgatggttgcacggatgtgaaccttgtctgtctcttcgtctcgtttcatagagtcaacaactactgctacagaatgcggaatctcttcacgagttaggtgcaagactttctcgcgaaccatttctgaaactaagaaacgttctggatggtctgtgatttgatcagacgggaaatattggaaaccttcatccagattttcactcaaaatatccactagacgagacacgttatttcccctgaagggctgagattggaacaatttccttaaagtccatttgattacggaagtcatcaatctgagacaagagctggtctggatggaccttatcgattttattcaccaccaaaatcacaggaaccttggcagccttgagacgctcgataatcatatcgtcccccttaccacgcgattcatcagcaggcaccatgaaaagaacagtgtccacttcgcgaagggtactgtaggcagactcaaccatgaaatctccgagagctgttttaggtttgtgaatccctggtgtgtcgataaagacaatttgctccttatcagtcgtgtaaattcccatgattttattgcgcgttgtctgcgccttgtcactcatgatggcaatcttttgccccataacgtgatttaaaaaggttgacttcccaacattgggacgtcctaaaatggctacaaagcctgatttaaaagtcataatttcctcttactgtgtaaaataataaatcccagaatcgtgggccagaaaaatcaaagcgcctgttaaggaagcaaaaagagaaaccactaataccgc

SEQ ID NO: 62 - DNA, 1652 bp; single-stranded, linear
gatctggagtggatgttgatttgaaattgccaccagaagaaagttctcctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctataaatgggataaagaaaatggtatccttaaagaagacttgacagacaaaggcttcaccaacgaatttgtgaaataatgacagaaattagactagagcacgtcagttatgcctatggtcaggagaggattttagaggatatcaacctacaggtgacttcaggcgaagtggtttccatcctaggcccaagtggtgttggaaagaccaccctctttaatctaatcgctgggattttagaagttcagtcagggagaattgtccttgatggtgaagaaaatcccaaggggcacgtgagttatatgttgcaaaaggatctgctcttggagcacaagacggtgcttggaaatatcattctgcccctcttgattcaaaaggtggataaggcagaagctatttcccgagcggataaaattcttgcgaccttccagctgacagctgtaagagacaagtatcctcatgaacttagcggtgggatgcgccagcgtgtagccttactccggacctacctttttgggcacaagaatcgaaatccctgagatgaggcctttagcgccttggatgagatgacaaagatggaactccacgcttggtatcttgagattcacaagcagttgcagctaacaaccctgatcntcacgcatagtattgaggaggccctcantctcagcgaccgcatctatatcttganaaatcnccctgggcagattgtttcagaaattaaactagactggtctgaagatgaggacnangaagtccnaaagattgccnacaaacgtcaaatcttggcagaattaggcttagataagtagaaanatagggagttggtgaagattatcccttttaccagcgcccttttttcttttaaaaatgaaganaatttcggtataatnntcaantaaggtcaaggtttaaananag

SEQ ID NO: 63 - DNA, 1256 bp; single-stranded, linear
ctagggcaacaagaatatatgcaacttctaacatttagttttcctcctctgtaatatagtaaggggccttctttcgattttgataaataacgatcattataccgagaccgataaagacaactgacagccattgggacactcgaaggccgaagaacatgagactatctgttcgcataccttcgatgaccatacgaccgaaaccataccaaatcaagtaaaaggccgtgatatgacctcgtctgagactcttccatttccgtctaaaaatcagaatcaaggcaaagccaagcagattccatagagactcataaaggaaagtcggttgacggtagctcccctcaatatacatctggtcacggataaagccaggtagataatccagattatccactgttgcaccataagcttcttggttaaagaaattaccccaacgccccaaactttgagcaatcataacgctaggcgccgcaatatctagaaaatcccaagtattgatgagtttacggtcagcaaagatatagagcacaagagccccagttatcaaaccaccgtaaatggccaaaccaccattccaaatggcaaaaatctctcctaaattctgactatagtaatcaaatcggaaaataacatagtagagacgagctcctaaaatagccaagggaaaggctactaagataaaatctaaaatatcgtctggtatgatcttctttctaggtgcttctttcatggtcaaataaaccgcaagaatcaagcctgtcacaatacataaggcataccaacgaatggctaggggtcctagttgaatagcaattggatcaagcattttgcacctcatttcgagctatgagacttgtcagtcgttcgtcgaacaaacgggtagcatcaaagcccatttccttggcacgataattcatggcagctgcctcaatcacaacagagatattacgacctgttttaactggaatacgaatacgaggaatggctacgccagaaacttcaagttcctctgcattgtttccaagacgatcaaaggtcttatgcgtatcgtaattttccaaatagacagcaagctgaacctgtgaagaatccttgacagcactcgcaccgtagagactcataacatcgataataccaaccccacgaatttcaatcaagtgtttcaaaatttcagctggttcaccccagagagtaatctcatccttggcaaagatatcgacacggtcatcggctaccaaacggtgaccacgtttgacaag

SEQ ID NO: 64 - DNA, 1847 bp; single-stranded, linear
aagagatggtgcctgctaacctaagccagtaattttcttctaactttggaaaattatgtaataccagagacggaccctttgttcgcctttacccagcccaatgtaacagctgacgaattttaacatcaatggtcagctacaaaatgaggtcgagcatgccaagatgagtaagattattgaccgttatcgtccagctggtgagggctttgtccgtatcgatactcaaaacaatatgcctacggcagcgggcctgtcctcaagttctagtggtttgtccgccctggtcaaggcttgtaatgcttatttcaagcttggattggatagaagtcagttggcacaggaagccaaatttgcctcaggctcttcttctcggagtttttatggaccactaggagcctgggataaggatagtggagaaatttaccctgtagagacagacttgaaactagctatgattatgttggtgctagaggacaagaaaaaaccaatctctagccgtgacgggatgaaactttgtgtggaaacctcgacgacttttgacgactgggttcgtcagtctgagaaggactatcaggatatgctgatttatctcaaggaaaatgattttgccaagattggagaattaacggagaaaaatgctctggctatgcatgctacgacaaagactgctagtccagccttttcttatctgacggatgcctcttatgaggctatggcctttgttcgccagcttcgtgagaaaggagaggcctgctactttaccatggatgctggtcccaatgttaaggtcttctgtcaggagaaagacttggagcatttgtcagaaattttcggtcagcgttatcgcttgattgtgtcaaaaacaaaggatttgagtcaagatgattgctgttaaaacttgcggaaaactctattgggcaggtgaatatgctattttagagccagggcagttagctttgataaaggatattcccatctatatgagggctgagattgctttttctgacagctaccgtatctattcagatatgtttgatttcgcagtggacttaaggcccaatcctgactacagcttgattcaagaaacgattgctttgatgggagacttcctcgctgttcgcggtcagaatttaagacctttttccctaaaaatctgtggcaaaatggaacgagaagggaaaaagtttggtctaggttctagtggcagcgtcgttgtcttggttgtcaaggctttactggctctctataatctttcggttgatcagaatctcttgttcaagctgactagcgctgtcttgctcaagcgaggagacaatggttccatgggcgaccttgcctgtattgtggcagaggatttggttctctaccagtcatttgatcgccagaaggcggctgcttggttagaagaagaaaacttggcgacagttctggagcgtgattggggattttttatctcacaagtgaaaccaactttagaatgtgatttcttagtgggatggaccaaggaagtggctgtatcaagtcacatggcccaccaaatcaagcaaaatatcaatcaaaattttttaagttcctcaaaagaaacggtggtttctttggtcgaagccttggagcaggggaaagccgaaaaagttatcgagcaagtagaagtagccagcaagcttttagaaggcttgagtacagatatttacacgcctttgcttagacagttgaaagaagccagtcaagatttgcaggccgttgccaagagtagtggtgctggtggtggtgactgtggcatcgccctgagttttgatgcgcaatcaaccgaaaccttaaaaaatcgttgggccgatctggggattgag

SEQ ID NO: 65 - DNA, 1360 bp; single-stranded, linear
cttcctccagcaaaatccactgctgagaagctaaagggagcgtgagatagccctctttctctactggttggtctgaaatccgagcctcaggaaaccagtcttgtagttctttttccctcatgttctagccctccactttttggatgcaccatgaaaccaaactctcaagacgttccagattctcagtcatatggagatagcccataaccgcttcaaatcccgtggacatacgataagtcacgacatctgcatttttagcctttgtgtggctattggtattgcggccacgtttgtagatttcttcttctttttccgttaggacctgctcctccaacatgagagcaatcaggcgagcctgagccttggctgacacatacttggttgcttcttgatggagtttattgggtttggtcatacctttgaggatgaggtgacggcgaatatacatagaatacaccgcatccccctcaaaggctagcgcaatcccgttaatgagattgacatcaatcacgtgtccacctcactccatccttggtatcaaggagcttaattccttgagtaaccaattggtcacggatttggtctgctgtctcaaagtctcgattggcacgcgcctcttggcgtttttgaatcaagtcttcaatctctgcatccaaaacttcctcaacaaagacaattccaaaaatttctaacatatctgcaagagcttgcttgacacttgcatcatagttccctgagttgatccatttggccatttcaaagacaactgtgataccgttggcagcattaaaatcttcatccatagctgctacaaacttatctttaaagttttgtaactcttgggcatccacgtttcctgtaaatggttgttcgtaagtattcttcagatacttgagattggtctcggcatcgcgaactgccttttccgtgaagttgataggcttacggtagtgctgggtcgcaaagaagaaacgaagtacttgcccatcaagagttttaagggcatcgtgtaccgtaatgaagttacccaaggacttagacattttgacattgtcgatattgacaaagccattgtgcatcccagttagttagcaaaagccttgcctgttttagcttcagattgggcaatttcattggtgtggtgtggaaactctaggtcagctccaccaccgtggatatcaatggtatcacctaaaatctctgtcgacatgactgaacactcaatatgccaacccggacgtccaggtccccaaggactatcccaagaaatctcacctggtttggaagatttccataaagcaaagtctacaggattttccttacgagccgtttcttcatcggtacgacctgaagcacctag

SEQ ID NO: 66 - DNA, 1297 bp; single-stranded, linear
ctatgaggtggccctggttttactggatatccagatgcccaagcttaacggcttagaagtcctagctgagattcgtaaaaccagtcaggttcctgtcttgatgttgacagcttttcaggatgaggaatacaagatgagtgcctttgcctctttggcagatggctatctggaaaaacctttctccctctccctcttaaaagtgagggtggacgcgattttcaagcgctactacgatacaggacgaatcttttcttacaaggataccaaggtggactttgaaagctacagtgcaagcctcgcaggtcaagaagtgcctatcaatgccaaagagttggaaattctggactatctagtgaaaaatgaaggccgggccttgactcggtctcagattatcgatgccgtctggaaagcgacagatgaggttccctttgaccgtgttattgatgtttatatcaaggaattgcggaaaaagctagacttggattgtatcctcactgtgcgcaatgttggttataaattggagcgaaaatgaaacgaacaggtttatttacaaagatatttatctataccttctcgatatttagtgttctggttatctgccttcatttagctatttattttctttttccttcgacttatctgagtcatcgtcaggaaaccattggtcaaaaggcaacagccattgcccagtccctagaagggaaagataggcagagtatcgagcaagtgttagacttgtattcccagactagtgatatcaaggggaccgtcaaaggtgagatgaccgaggacaagttagaagtcaaggacagtcttcctctggacacagaccgccagacaacctctctctttattgaggagcgcgaggtgaaaacgcaagacggtggtactatgattctccagtttctagcttccatggatttacaaaaggaagcggagcaaatcagtctccaatttcttccctataccttgctggcctcctttctgatttccctcttggtggcctacatctacgctcggactattgttgcaccgattttggaaatcaagcgggtgacccgtcggatgatggacctggattcccaagtgcgattgcgcgtggattctaaggatgagataggcaatctcaaggaacaaatcaatagcctctaccagcatctcttgactgttattgcggacttgcatgaaaagaatgaagccattctccagctggagaagatgaaggtcgaattcctacaaggagcttctcatgaattgaaacacaccgctggctagtttgaaaatcccaatcgaaaat

SEQ ID NO: 67 - DNA, 1043 bp; single-stranded, linear
cttgttagagtcctactcgcgagagcaagtcaacttctttgtggatcaaggtgctgttaccatagtccaaaaggaagttcgacgctcggctgcttattttgaaggaattgaagcaagtagacctttggagttaaatccagaacaaagacaggcgcgtgatgcggttgtgagttctattggcagttctcaacctccctttctacttcaagggattacaggaagtgggaagaccgaggtttacttgcagattatccaaggtgccctggataagggcaagacagctattttgctggtacctgagatttccttgactcctcagatgaccgagcgttttatagcacgttttggggacaaggtagccattcttcactcaggattatccaatggtgaaaagtatgatgaatggcgcaaggtggagcgtggcgatgcccaagttgttgttggtgccagatctgctatctttgctcctctgaaaaatctgggtgtcatgattattgatgaagagcatgaagcggcttataagcaggacagcaatccccgttaccatgccagagaggtagctattttacgggctcggtataatcaagcaactctggtacttggatctgcaacgccgagcttagagagccgggcacgtgctggcaaaggcgtctatcaacacttacgtctaacccaacgtgccaatcctttggctacaatccctgaggtttcaagtgattgactttcgagactatatcggacaaaatgagacgtcaaactttacgcctcctttgctagaggctatccaagaccgtctggttaaaaaagagcaggtggttctcatgctcaatcgccgtggttattctagctttgtcatgtgtcgggagtgtgggacggtggatacttgtcccaactgcgatatttctctgaccttgcatatggataccaagactatgaactgccattattgtggtttctcgaaggatattcctcaggtctgtcctaactgtaagagccgcagtattcgttactatgggacgggaactcagaaggcttatgatgag

SEQ ID NO: 68 - DNA, 1449 bp; single-stranded, linear
ctagtgcgtcctagtttacggtaagccatgtattcctcctttatttatcttttaatccaagacccaaatcaatgagtttgagtttcacttcttccaaactcttgcgtccaagatttcgtactttcatcatctctgcttcagatttttctgtcaaatcatgcacagtattgataccggcacgttttaaacagttgtatgaacgcacagacaagtccagttcctcaatcgtacgatctaaaatacggtcgtcagattcagtatcagcttctttcatcacttcagttgacttagcaatctcagtaagatttgtaaacaaatcaagatgttctgtcaaaatacgtgctgaaagccctaaagcatcttctggaataattgttccatttgtcaagatttcaagggttaatttgtcgaaaccatcattgctacctacacgagcaggttccacttgatagttgacttttgtaactggtgtataaatagaatctacagcaagtgttccaactggtgcattatcctttttattttcatcagcaggtacatatccacgaccactgttaacagtcatagtcgcttttagagaagaaccttcaccaattgtaaagagataatgatctggatttacaatttcaatatcgctatctgtcaaaatgtcaccagctgttacttcagcaggaccttcaacatccagttcgatgattttttcgtcttcaacgtacgatttcactgcaattcctttaatgttcagaatgatttgcatcacgtcttcacgaacacctggaactgtgtcaaactcatgtaacacaccatcaatgttgatagatgtcacagctgctcctggtagagaagctagaagtacacgacgaagagagttaccaagagttgtaccgtagccacgttcaagtggttcgattacaaacttgccataatctttattttcatcaatttttgttatatttggtttttcaaactcgatcatttagttactccctcttaaacgaaaagcagtgtaatgcgatgattatacacggcgacgttttggaggacgagcaccattgtgtggcactggagtcacatcacgaattgctgttacttcaagaccagcggcagcaagcgcacgaatagctgactcacgaccagaacctggaccttttacagtaacttcaactgatttaagaccgtgttcttgtgcagatttagcagcagcttcagaagccatttgagcagcgaatggtgtacatttacgagaacctttgaaaccaatgagcaccagctgatgaccaagcaattgcattaccatgcacatcagtaatcataacaatagtgttattaaatgtagcgtgaatatgagcaataccagattcgatattctttttcacacgacgtttacgtgttggtttagccaagacttttacctcctatattattttttcttaccagcaatcgcaacag

SEQ ID NO: 69 - DNA, 1167 bp; single-stranded, linear
cttgtgtatgattttcgatatccaaaatttgttgttcagaacggccgtcaaattttacagttgaaattgaatctttcaaaccgatacgttcaatcaaacctttggctaacactttttcctctggcattaagtataattgccatttcaaacttgaacttcctgcattgattgcaattgtttttgtcataacatgatacccctttttaagcgttttcaactattataacaaaatctattttatatttcagtaccttgagtccatttttgaaaattttctttaaatttcattaaaacacttgcatcttgcaagctagcaagtggataaacaaaaggctccactgctatttcacttttcttctgtaggataaaaatagtcttagattgtttagcattagcaaagagattttcaggcagactaatcatagcaaccagactcgcctcttctttcagccattcttttaacaaatcactttgaggactggtcaacaaatcactcggagctagaaaaataggcgtatccgtctgacttgaggtacttaagcccttgttccatgagcaagtgatgggcgtaagtatgttcttggctagaagcaactggatggcgcgacgcaacggcatcatcaggataatagccaacaggcaagtcactgatgaccacatcgctttctttgagcatttgtggacgaacggcatctccttggacaaagccagcctgcaaaccaattacatctgccatgctagctgccagatcaatcagcaaatcatccacttccattcccaaataatccacctttttagtaagcgaggtcaagaaagtagcgcccaaaattcccatcccagaacccatttcgaggatagtaatttcctcctctttaaacagctcttccacaataaacaccaaaagtaaagcaatagcatccggtgtaaactggtgattggcctgcaagggttctgtttgcccagccttcatcaagagaaactggtaggtcttgagccattcttctttgcgtagtgctaaacgcttaagggtctgattgttgtctttgacctgttctagctcagtctcaccatccagatagatgctgttttgctccaccaaggcgtcataaaagttggncgccaaatcactttggatgacttggacatncnctagtaaataggtataag

SEQ ID NO: 70 - DNA, 1644 bp; single-stranded, linear
tttttaccacttcaccggagtttttcttccttaacttccatcaggattaatcgctgtaaagatacgtttctttaaccagtttttccttcttgttcnacacgagtttcacctagaaacagtgttgaatcttttttctcaactgtcttgaaggccaaatctttttcaacaaaatttcgagttgtggggaagatctttcttgtaacagcagcaactgtctttctccagaaactggtttttcccttagtcaactggataccggtattccttaacttgttttccactttctgaaacgaggcgaacaagtactggaaggcaatcttctccactatctaccacagttgaagctacttgattgttttcttcaactgagacttttggccgttgacctttataggtaatttgatagtcttgacgattttcagcgaaatcagcaagttcttttccatctacaagaatcttcgattgcgtgctttcttgaggcaattcacttggtgcaaggaaggtcatctcaatcatcgcaacaccgctcttatctgctttacgctccatacgccatctcatagctttggctttgacagctttaaatgttacgttgatttcatcaccagctgcgatgtctttatccgcacgataaggcacagcttcccaattttctggattgttgaatggatggtctgcgtcgtaggcttggtagtttgaatagtaggttggcacttcaaactctggaccgacatagcgttctaaaacgagtttagttggtgcatccgtaccactatctgcaaagaagtgaagtttggcttgcgcaacagtccgttctacaatcttaccattttcacggaagatcacacccgctgatacttctggattagaagatggtgttggagaccagtttgtccaacgacgattttctgaatgatctccgtcattgagatagtcaacgcggtcatgagagtttttgtcaatatcattggttgctgaagcaaaggcctggttactgttttcatcatagttagggttatctgaaagagcttcgcctagtttgtctgtcactcgtacagtgacctcagcaacaagatcactaccaaggacatggcctcgaacggtaaattgacctgcttttgtcagattttctgctggaacttcttcccattcaactgacaaatcttttgtttcgtagccgtctttacctgtgaagtaaactggaaccttagtcggcaattcaagtgcttgacctacttgtagcaagcgagcttgtttaaccgcagcaactggtttatgagaaagtaagttcttatccttagtgaagtgcagacggtattctcctaagatgtcgccattttcagctttcgcgatgacacgaactggctcaccttcacgaacgcttggaacgacggtagcgagaccattgttgctaacacttggctgtgactgccggaactttcccatctacagactcaaggtagtatctgtcagatcaggttgaagtttgctaagtctttaccgtcaacttggattcttgttgtccttgcttggctgccgcaacttgtttcgcaaagatttgtacctctgtgataacgttcctaatttgttgtctgctctcaccatggcgaatacgaacagcataggtttcaactttatcaagag

SEQ ID NO: 71 - DNA, 1448 bp; single-stranded, linear
ctcccagcatgtactcacctgtttggtaattcttataaagctgatgacggctccttcttgcaccaattgctcaatccccttgtggaaggatttttgcttcataacattcttagcagaaactttcatgaaaatttcaggagtaaaggttggcagtggttcaaattcaaacttgttttttccaaccgtcaaggtatccccaacctgataagtaccggtatcgtaaaccccgataatatcacctgctacggcattggtcacattctcacgactctccgccataaactgggtaacattagatagtttggcacccttaccagtacgagggagattgacactcatgccacgctcaaattcgcctgatacgatacggacaaaggcaatacggtcacggtgacgaggatccatgttggcttggattttaaagacaaagcctgagaaatccttgtcataaggatccacaatttcaccgtctgttttcttgtgaccatgtggttctggagcaaacttgaggaagatttcaaggaaggtctgcacaccaaagtttgtcagggctgaaccgaaaaagacaggcgtcaattctccagccagaatagcttcctctgaaaactcattcccagcttcatttaaaagctcaatgtcatccttgacttgctcgtagaaaggattgctaccaaaaagtttgtctccatcttctagggctagcaaaacgctcatcccctttgtaaagctctaaacgttggttatagaggtcatacaagccctcaaaggctttccccatcccgataggccagttcatagggtagctagcaatgcccaagatttcttccaattcttgcaagagatccaaaggctcacgaccgtcacgatccaacttgttcataaaggtaaagactggaatgccacgatgtttcacaacctcaaacaatttctttgtttgagcctcgatccccttggcagagtccacgaccatgaccgcagcatccaccgccatcaaggtacgataggtatcttctgagaagtcctcgtgccctggcgtgtctaagatattcacgcgcttgccgtcgtagtcaaattgcataacagatgaagtaacagaaatcccacgttgcttctcgatatccatccagtcagatttagcaaaagtccctgttttcttcccttttaccgtaccagcctcacgaatctcacccccaaagtagagtaactgctcagtgatggttgttttccccgcgtccgggtgggagataatggcaaaggtacgacgtttcttaatttcttcttgaatattcataagttctctttctttgattctctattttccttgtttcaatagctgagaatgatttgtacattggattttaccatcctttcgacactccattatatcggatgttagcattttttccaatttctatttctttccacttccccctcccttatttatagga

SEQ ID NO: 72 - DNA, 1971 bp; single-stranded, linear
ctcctagagcaacttgaaggacacctgatataaaggaaaggataacagccgctttccatccgccgcgtttatcagcgtagaccgcaatggctgcattgtcaaagaacactggtacaaatcctgtaataataagaatcggatttttaaagacgatgagcaagacaattgtaatcaattgaccaatcaaaccaaaggtaaatcctgacaagacagcatttggagaaccaaatccataagaagctgcaaagtcaaccgctgggaatgaacctggcaacaatttgtttgaaataccttggaaggcgtttgtcaactcagatacgaacattcggacaccttgcatcaaaacgaacaagtaaactgagaaggtaaaggctgtttggataatgtacataaagaaatcttgtttagcaggattgaatagagttcctgaagtgatgacttctttattagacataatgtctggacccaagattaaaagaatggccccgaagaatacgagcatcaaaggtagcagatgcaacaactgtatcgtggaagattgagaggaacttaggtaatttaagattgtctaaactttcttctttcttaccaaagcgtcctgctactttatctacaaaccagattgcaaattgctgttggtgaccaatcgcaaatccgccaccaccagtcaagcgttgagttgcctcaacagtcatatttgaactaactgcccagtaaagtccacagatgataccaatcgctgctgtaccgtaagcattgcgcaattgtggtactaagaatagaaccataagagatactgttgcagctagccatgctgatcaattccctcaaccagtcctatatctcagccaagagaatcgaggaggtctttgcggaatctcccgaaaacatccattcagaattagaacaaaagcaagttaccagtggtcgggttttacaagtccaagaattgacttttacctatcctgatgcggcccagccttctctgagagacatttcctttgatatgactcaaggacaaatccttggtatcattggggggactggttctggtaaatcaagcttggtgcaactcttacttggactttatccagtagacaaggggaacattgacctttatcaaaatggacgtagtcctcttaatttggagcagtggcggtcttggattgcctatgtacctcaaaaggtcaaactctttaagggaactattcgttccaacttgactttaggtttaaatcaagaagtatctgaccagaaactctggcaggccttggagattgcgcaagctaaggattttgtcagtgaaaaggaaggacttttggatgccctaattgaagcaggggggcgaaatttctcaggtggacaaaaacaaaggttgtctatcgcccgagcagtcttgcgccaagctccgtttatcatcctagatgatgcaacctcggcactggataccattacagagtccaagctcttgaaagctattagagaaaattttccaaacacgagcttaattttgatctctcaacgaacctcaactttacagatggcggaccagattctcctcttggaaaaaggtgagttgctagctgttggcaagcacgatgacttgatgaaatccagccaagtctatcgtgaaatcaatgcatcccaacatggaaaggaggactagaatgaaacgacaaactgtaaaccagacgctcaaacgtttagccgttagatttagcaaaccatcccttcctccttttcctagcctttctaggaactattgcccaagttggcttatcaatttacctacctattctgattgggcaggtcattgaccaagtcctagtggctggttcatcaccagttttttggcagatttttctccagatgctcttggtggtaataggaaatactctggtacaatgggccaatcctctcctctataatcgtctaatcttctcttataccagagatttgcgagagcggctc

SEQ ID NO: 73 - DNA, 620 bp; single-stranded, linear
tnttttgcccnttgcgcgtccttttaggaaaacggtatcgagggccntgatcttatcttttcaatntatgtanaacccagtgagttgaaaaaaattgccagtgaattagacacgacggaaaacaaccttgaaaaattcaacgaatgactattggtggaaaaaattgaccgtctactatatgattgacgatgcaggggttggtgtgaaaattttgacatcaagtaaagatgccaatgacttgttagagaaaaaaattgatgggttgattgagaaatttaaacatgcttatgcaaatgtgaaaattgaaaaactggaaaccatcaactctaaagaaattgaacgcaaatggtgaaacagcgcttggcttaaatgtgaaaaatctgatnctncgtttagttgttattggagtggtttgtgtgatttgggtngtgatgggaaatgtgttagtttatctctttaatccaccaatcantaaantaggtgattttccccncctaccnnntnaattttgttnccaaaanttaannccattgccnccctncccaaattttttgtnctnccccnatttccnnaccggaatttgttcccnnnntatttaaccccccccccccccccctttt

SEQ ID NO: 74 - DNA, 1550 bp; single-stranded, linear
ctggtcctngaggtcaatcaattcccccagataggnctcaactcccaaaacacctcctcccactcgtgccaaaacacgattggtcaggtagattcgatccatctcctcaaatgaantttcagaaatgacatgtgttacaaattnatctactaaggtcactatagagcctccnttngactagtcaaggacgcgagtgccacctgaaacttcagcgatatagaaggctnggagggtatccaactacttccttgtagagtttgcctacagcttccttaaaggcctcaacagtatctttttgaaccaaggcaatggcacagccaccaaaaccagcccctgtcatacgagcaccgagaactccttccttgtgcccaagctgtgtgaacaagagtatccaattccaaaccagttacttcataatcacgctccagagaaacgtgtgacgcattcatcaaacgaccaaatgtttccaaatcacctgcttgaagggctgcttgagctttaagggtacgttggttttcaagcacagcatggcgagcacgtctcaaacgattttcatctttaatcagatagctatattggtcaacggcccactcgtccaattcacccagggtctgaatatccaaggcaacttgcaattcttccactgctttttcacactcagcacgacgttcattgtatttagagtccgccaattcacggcgtttgttggtgttcatgataacaacgacattgtccttcaaatcaagtggcaccaagtcgtattctaaagtattggtatctaagtaaatagcacgttggtcagcccccataccaatagcaaattggtccataatgccagaatttactccgataaagttattttctgtttgttttccgattttaaccaaatcgagacgctctagttttaaatcaaagagatgctctgccacaactcctgtcaagagctccaaggatgctgaagaagacaaaccaccaccatttgggatattcccataaacataaaaatcaaaacctttgtcaatcacgtgcccagcttcttgcaagaaatgaaggacaccttttggataattggtccagttgtgctctttttcaaacttgaggtcagcgagaggcacttcgataatgcccttgtcctcaaagttagctgagtagaaacgcaagacttggtcgtcacgcttacgagctgcaccgtaagttcccaaggaaatagcaccaggtaaaaacgtgcccaccgttgtagtctgtatgttcaccaatcaaattaatgcggcctggtgaaaagaaggtttggtctgcttcttgaccaaaaacagcaagaaagtctttgcgaagggcttcagtagtaagatgttgtgccatatgaattctcctttgactgtccgttaagccatcttaacgagtaatcgttttctttctattgtatccaaggaattttccgaggtcaatcctttttactgaaattttagtaaaatatcagtaaaaagaagaaaaacatgatatactaacctaatcaaggaggatttatggctaccttaaaagacattgcacag

SEQ ID NO: 75 - DNA, 1139 bp; single-stranded, linear
gtggcggccgcttaagaattagtgggatcccggggctgcaggatttgaactcaatgcatccaaggcgtcatccattgaaagaacttcgtggaagacacgttgtgtcaattcagttttttgttctggagtgaggtatttagtgtttacacagtatccagagatacgtacgataacgtcttcgcctgacatgattttttcgtaaacatcgttcaagtccataacgttcaagttaacgtgttgtccaccgttttcgaagtaaccatcaaggattgttaccaagttatcaacttgttcatcacgagtcttaccaagagcgcgaggtgatacttgtgtagtcaatgagataccgtcagctgcataactaaagtcaaggctagaaagtgagttcaagttttgcaaccaaccacctttagctttgttagatgggttagcacctggtgagaagaattcaagtttagacaagttcacagaaccatcttcgttgaggtatacacctttgtgaactggtgagttaccagtttgtttagagtaagcaacgttagatgtgattgtcaaaagtgatactgtagcttctgcgtctttgtatagtttgtggctacgtaaacgagttgtgtaagcttcgattaaccattctgccaattcgtttgaacgtgggtcatcttcaccccagcgtgggtagtcaccgattgtttcgtaatcgtagatgtagccatcttcgtcacggattggtttaactgtagcgtatttgatagctgacaatgtatcaacagtgttagcaaatccacagataccgaatcccatgttggcacgttgtttagttggcaagaaggccatttgaacagcttcgtagttgtacctatcagtcatgttagtggatgatgttcaaggcatctacgtaagtgtcagtcaaccagtcaagagatttttcaaagttcgctttaactgattcaaattcaagaacttcgtcacggattggttcgatatcaaatactttgtagtctttgtgaacatcgtcgtaaccaccattcaaaccagtaagaagggctttaagaacgtttacacgagcaccgaagtactggatgttgtggcgttgttcttcattttctggatcaagtggagacacacagcatgagatacag

SEQ ID NO: 76 - DNA, 1326 bp; single-stranded, linear
caaaaccagtctttccttggctgagaaaaacagctgttaaggctccaaccaagtctcctgtccctgttatccagtctaattcagtacagccattctcaagtacagcaacttgattctccgaaacaataaggtccttgggacctgtgactaagaatgacataccaggataggtctgacaccagtctttcaagacttgaagcaaatcctccgtttcttgatctttagcactcgcatcgaccccaacgccgtgatgctttaatccaacaagacttcgaatttctgacatgtttcctttaaggaccgtaggtctatagtctaaaaggtctttaactaagctcttacgaatggatgaagtcgttacgccaaccgcatctactaccatcgggagagaagattggtttgcatacaaagctgccatgcggattgctttttccttctcagctgacaaatgccccaaattgatgaagagagcctggctttgcttagtaaaatcaagaacttcacggggatcatctgccatgacaggtttgcatcccagagccaaaatcccatttgccagcatctcacaagaaatctcattggtcatacagtgaatgagggaactagagcctataggaaaaggatttgtcaatgcctgcatcattctatcctttcagcaaagaaatatccttgcacttttttaaagaattcctgcttgattaaaaatctaaatgcaataaaggaaatcgctgtaccaatcaaggttgctccgaaaaatcgaggcgtgtagataaaccaactaagcttagcagccgatcctgtaaagagcaccataacaggataggaaacaatagaaccaataatacctgttcccacaatttctcccaaggcagaaaagtaaaattttcgaccgtacttataaaagagacctgctagaagggctccaaaagtcgctcctgtgagagataaaggagcttatcggaatacccttgagtcgtcatacggataaaggctgtcactgtagccatagccaaggcataaacaggtcccatcatgattcccgctagaatattgactacactggacatcggtgccattccctcaatccgaaagataggtgtaaggactacatcaagggcaatcatcatagataaaatggtcaatttgtgaacttgtagttggtgctttctcaagtttctattcttctcctttttctaaagactgtaaatcgctcttccatgtctggtgttggtaagccatctcccaaaacttggcttccatatgaacactgatgtggaaggcatctagcattttttgcttatctgtctcatcactttctcgatagag

SEQ ID NO: 77 - DNA, 1056 bp; single-stranded, linear
ctagtccagagggtgcaatggctagtgatggtacttggcaaggaaaacagtatctgaaagaagatggcagtcaagcagcgaatgagtgggtttttgatactcattatcaatcttggttctatataaaagcagatgctaactatgctgaaaatgaatggctaaagcaaggtgacgactatttttacctcaaatctggtggctatatggccaaatcagaatgggtagaagacaagggagccttttattatcttgaccaagatggaaagatgaaacgaaatgcttgggtaggaacttcctatgttggtgcaacaggtgccaaagtaatagaagactgggtctatgattctcaatacgatgcttggttttatatcaaagcagatggacagcacgcagagaaagaatggctccaaattaaagggaaggactattatttcaaatccggtggttatctactgacaagtcagtggattaatcaagcttatgtgaatgctagtggtgccaaagtacagcaaggttggctttttgacaaacaataccaatcttggttttacatcaaagaaaatggaaactatgctgaaaaagaatgggtctacgattctcgagaatagtcaagcctagtactacttctaaaatccggtggctacatgacagccaatgaatggatttgggataaggaatcttggttttacctcaaatctgatggcaaaatagctgaaaaagaatgggtctacgattctcatagtcaagcttggtactacttcaaatctggtggctacatggcgaaaaatgagacagtagatggttatcagcttgaaagcgatggtaaatggcttggaggaaaagctacaaatgaaaatgctgcttactatcaagtagtgcctgttacagccaatgtttatgattcagatggtggaaaagctttccctatatatcgcaaggtagtgtcctatggctagataaggatacnaaaaagtgatgacnagcgcttggctattactatttctggtttgtcaggctatatgaaaacagaagatttacaagcgctagatgctagta

SEQ ID NO: 78 - DNA, 1426 bp; single-stranded, linear
ctggaccacactattttctgtgttggctatcgtgtcatgcaaaaggatctagaagggacgctggatgctgaaaaactcaaggctgctggtgttccgttcggcccgctttttggtaaaatcaaaaacggccaggatcttgttttggaagacggaactgaaatcaaggcagcagactatatctcagcgccacgtccaggtaagattatcactattttaggagacactcgaaaaacggatgccagtgtgcgtctggctgtcaatgcagatgtcctagttcatgagtccacttatggcaagggtgatgaaaaaattgctcgtaaccatggtcactcaactaatatgcaagctgcacaagtagcggtagaagcaggtgccaaacgcctcctactcaaccatatcagtgcccgtttcctctcaaaagatataagcaaactcaagaaggacgctgccacaatttttgaaaatgtccatgtggtcaaagacttggaagaagtggaaatctagcagtcacagaaaggataagtatgcctactattctcattaccggagctagcggtggtctagctcaagaaatggtcaaactcttgcccaatgaccaactcatcttgcttggtagaaataaggaaaaattagcccaactctacggaaattattcccatgcagaattgattgaaattgatattaccgacgattcagccctagaagctctggtaactgatctttatctccgctatggcaagattgatgtcttgattaacaacgctggttacgggatttttgagggatttgaccagattgctgataaagatattcaccagatgtttgaggtcaatacctttgccctgatgaatctgtctcgtcaccttgcggctcgtatgaaggaaagcagcaaagggcatatcatcaacatcgtcagcatggcaggtctaatagctactggcaagtctagtctttactcagcgaccaagtttgcggctattggtttttcaaatgctctgcgactcgaacttatgccctatggagtctatgtgacaacagtcaatccaggtccaatccgaacaggattttttgaccaagctgacccagatggaacttatcttaaatcggttgaccgcttcctcttagaggcagatgcagtggctaaaaagattgtcaagattataggcaaaaataaacgagaactcaatctcccgattttgttgaacctagcccataagttttatactctctttcccaagctagctgataagttggcaggggaaacttttaattataagtaaaaagaaccaatgtgcaggttgttgctagcctacatattggttcttatcatttctcaactatcaaactgaacttcttctagtagatagtcgataaagcgttcgcccatcttagataggctggttttctcatgctggatatagaccag

SEQ ID NO: 79 - DNA, 1702 bp; single-stranded, linear
ccaagcttgcccaattgtcggcagggtttcgatggaccaaatcactattcgattgcctaagctttatccgctaggaaccaaggtaaccttgattggctccaatggggataaggaaatcactgcaactcaggtagcgaactaccgcgtaaccattaactatgaggtggtttgcctcctcagcgaccgtattccgagagaatattattagaaaagaaaggagtggagcatgaatctacatcaacccttgcatgtcttgcctggtgtgggaccaaagtcagcagaaaaataacgccaaactaggaattgaaaacttgcaagatctcttgctctactttcctttccgttatgaagacttcaaaaccaagcaggtgctggaactagaagacggtgagaaggcagttctttctggtcaggtagtgactcctgctagtgtccagtattatggtttcaagcgcaatcgcctgcgttttagtctcaagcagggagaggtcgtttttgcggtgaatttctttaaccagccctatctggctgataaaatagagttgggagcaacccttgctgtctttggaaaatgggaccgcgctaagggctagtctgactgggatgaaggttctggctcaggtagaagatgacctccagcctgtctatcgtctggctcagggaatcagtcaggccagtctggtcaaggtcatcaagacggcttttgatcagggactggacctcttgatagaagaaaatctgccccagtctttactagacaaatacaaactcatgtcccgttgtcaggcagtccgagctatgcattttccaaaggatttggcagaaaacaagcaggctcttcgccgtatcaagtttgaggaactcttttatttccaaatgcagctgcagacgctcaagtctgaaaatagagttcagggaagtggtctggttctggattggtctcaggaaaaagtgacagcagttaaagcaagtcttccttttgccctgacccaagctcaggaaaagagtttgcaggaaattttaactgatatgaagtccgaccaccacatgaatcgtctcctacaaggagatgtggggagcggaaaaacggtagtcgctggcttggccatgtttgcggcagtgacagcaggttatcaggctgccctaatggtaccaacagaaatcctcgcagagcaacactttgagagtttacagaacctttttcccaatttgaaactggctctcttgacaggttccttgaaagctgcagaaaagagagaagtcttggagaccattgccaagggtgaggctgatttgattataggaactcacgctctgatacaagatggggtggagtatgctcgtcttggtttgattattatcgatgagcagcaccgttttggtgtagggcaaaggcgtattttacgggaaaaaggcgacaatccagatgtcctcatgatgacggcgactcccattccacggacgcttgccatcacagcctttggagatatggatgtttccattatcgaccagatgccagcaggtcggaagcctattgtgacgcgctggatcaaacatgagcaactacctcaggtcttgacttggttagagggggaaattcaaaaaggttcccaagtctatgtcatctctcctttgattgaagaatcacaagctcctagatttgaaaaaatgccattgccttatcagaggagttgactactcc

SEQ ID NO: 80 - DNA, 663 bp; single-stranded, linear
ctatgaaggacctggttcagaagttggcaagtaaagaagaattgtcgacagcagacaatgaaatgattgaattattggctcgttttaatgaacgccaagcctccttttttggtcagttttcggttagaggctatgttaactacgataagcatgtagctaagtatttaaaaatcttgccagaccagttttcttatcaagcaatagaagatgttgtcaaagcagatgctgaaaaaaatacttccaataatgagatgggaatggaaaattatttctataatgagcagatcaagaaggatttgaagaaattaaaggattctcagaaaagctttacctatctcaagtcgccagagtataatgacttgcagttggttttaacacagttttctaaatctaaggtaaacccgatttttatcattccacctgttaataaaaaatggatggactatgctggtctacgagaggatatgtaccaacaaacggtgcagaagattcgctaccagttagaaagtcaaggttttaccaatatagcaaatttttctaaggacggtggggagcctttctttatgaaggacaccattcaccttggttggttggggttggttggcttttgacaaggcagttgatcctttcctatccatcccacaccagatcgaagtcctgcag

SEQ ID NO: 81 - DNA, 1365 bp; single-stranded, linear
cttgtcttttgatttttggaggtgttgatgaaaacatttcttgtcaaacaaaagtttcgtcttggaggcgaacgcttcgctatcaaggatgacaggggagaaattgcctatcaggtggagggatcattttcttaagattcccaaaacttttaccatctatgatgcggctggtgaacaagtcagtcagatcagtaaagaaatcttgaccttgcctcctcgttttggagattcagcttcgggatggctcgagttttgtcattcgtaagaagttgaccttttggcgagataagtatgagtttgataatctaggtcttcgtatcgagggcaatatctgggatttgaatttcaaattgctggatgatcgcgatcagttgattgcggaaattaagaaggaactcttccatctgacctctacctataccgtaacggttcttgaagacgcttatgcagacctagtcatttccctctgtgtcgcgattgactatgtggaaatactggaaagccaatcacattaaacaagtgaataaggagacaatatgaaacaactatctagtgcacaagtacgccaaatgtggcttgatttctgggcgaccaaaggtcactcagtagaaccatcagtaagtttggttcctgtaaatgacccaactcttttgtggatcaactctggggtagcaacccttaagaaatactttgacgggaccattatccctgaaaatccacgtattaccaatgcccaaaaggctatccgtaccaacgacatcgaaaacgttagggaaagactgcgcgtcaccataccatgtttgaaatgttggggaacttctctatcggggattacttccgtgacgaagctatcacttgggcttatgagcttttgacaagccctgaatggtttgatttccctgctgaaaaactttacatgacctactatccagacgataaagattcttacaaccgctggattgaagtgggagtggatccaagtcacttgattccaattgaggacaacttctgggaaatcggtgcgggaccttctggaccagatacagaaatcttctttgaccgtggggaagcctttgacccagaaaatatcggtcttcgcctgcttgcagaagatattgaaaacgaccgttatattgaaatctggaacatcgttttgtcacaatttaacgcagaccctgctgttcctcgtagcgaatacaaggaattgccacataagaacattgatacgggcgctggtttggagcgtttggtggccgttatccaaggggctaagaccaactttgaaacggacctcttcatgccgattatccgtgaagtcgagaaattgtctggtaaggtttatgaccaagatggcgacaacatgag

SEQ ID NO: 82 - DNA, 1322 bp; single-stranded, linear
ctccaggtaatgtcaaggctaacgtggttccaattcaaaaactgattgatatttcaaaagacccacgttttggagaaacacatgcccttatcttgtttgaaacacctcaagatgcccttcgtgccatcgaaggcggcgtgccaatcaagactcttaacgttggttctatggctcactcaacaggtaaaacattggtcaataccgttttgtctatggacaaagaagatgttgctacatttgaaaaaatgcgtgacttgggtgttgaatttgatgtccgtaaagtaccaaatgattctaaaaaagatttgtttgacttgattaacaaagccaatgtcaaataagccattatttatgaaaggattttaaacatgtctattatttctatggttttagtagtcgttgtagccttcctttgcaggtcttgaaggcatcctcgaccagttccaatttcaccaaccacttgtagcctgtacccttattgggcttgtacaggtccttggaagcagggattatcctcggtggatcgcttcaaatgattgcccttggttggtcaaatatcggtgctgctatcgctcctgatgctgcacttgcttctgtcgctgctgccattatcatggttcttggtggtgactttaccaagactggtatcggtgttgcccaagcggttgctatccctcttgccgtagctggacttttcttgacaatgattgttcgtacaatttcagttggtttggttcatactgcagatgctgccgctaaaaaaggtgacttcggcgctgtggagcgtgcgcatttcattgcgctacttttccaaggacttcgtatcgcgcttcctgcagctcttctcccttatggtaccaactgaaactgtacaaagtatccttagtgccatgccagactggctcaaagatggtatggctatcggtggtggtatggtcgttgccgttggttacgccatggttatcaacatgatggcaactcgtgaagtatggccattcttcgctcttggtttcgttctcgctgctgtgtcagatattactctaatcggattcggtgctatcggtgttgctatcgctcttatctaccttcacctttctaaaactggtggaaatggtggcggaggagccgcaacttctaacgacccaatcggcgatatcctagaagactactaagataagaaaggactgaaaacatcatgactgaaaaacttcaattaactaaatcagatcgtaaaaaagtttggtggcgttcaaccttcttacaagggtcttggaactttgaacggatgcaaaacttgggctgggcttatacactcattccag

SEQ ID NO: 83 - DNA, 745 bp; single-stranded, linear
ctgggataaccaagcgaatcacagaaccgtcattagccggtgtgataccaagatcagaagcgttcaaggcacgttcgatgtctttcaatgaagacttgtcaaatggtgttaccaacaaaacacgcgcttctggaatcgtaattgaagcgatttggttaagaggagtttcgactccatagtattctacatgtacacggtcaagcaagcttgcattggcacgaccagcacggataccaccaaattcacgagcaagtgattggtgagactgggtcattctctctttagctttttcaataattacgttagccatattctttcttattccttttcttcgatattatttgaaactgttgttccgatattttcaccaaatacgacacgtttgatgttgcctgattggttcatgttgaagacaaccaagtcaatgtcgttgtccattgagagggttgaggctgttgagtccatgatacgaagacctttgttgataacatcacggtgggtcaattcttcaaacttaacggctgtcttgtccttcttaggatcggcattgtacacaccatcgacgccatttttagccatgaggatggcatctgcttcgatttcagctgcacgaaggccgctgttgtatctgtcgagaagtatggtgaaccaattccagcaccaaagataacgatacggcctttttcaaggtgacgaagggcacgtccacggacataaggctctgccacttgttgcatagcaatag

SEQ ID NO: 84 - DNA, 636 bp; single-stranded, linear
ctgataaatctatatccagatttagatttcattgtgacgacggtagctttgcaggaaccagcaagtgtcccgtttgtcctagttagtgcttttctaaccgagggtgataaacaacgtcttcaagcaaaaattcaggagataaactatgaataatctttcgcttgtccttatggatatatctgttcaaaatcgtcaagaagcctacaaagaattagcaaatcaaatcagccttcttgtttctgaagatacagaaaaaatagaagagcttctatattaccgtgagagacagggaagtatagaggttgctaaaggtgttcttctaccacattgtgaaggaaactttcaacatcatgtcttagtgattactagattaaaaccacctatcagagaatggtcgaaggatatccagtgtgttgaccttattatcggtttggccattgcagtatcacaggacaagtcatgtattaaaacattgatgagaagactagcagatgaatcattcataaatcaattaaaacagttaacaaaagaagaattacgggagataatatatggaaatcaaagatattcttaatgtgagtctgatccagacggatttacagatgcagagcaaagaagaggtttttgaggcattag

SEQ ID NO: 85 - DNA, 1128 bp; single-stranded, linear
ctggtacaatcggtgtgatggacgctatcgtgaaacaaccaggagttaaatcaatcatcggtggtggtgactcagctgccgcagcgattaaccttggccgtgcagacaagttctcatggattagtacgggtggtggagcatcaatggaacttcttgaaggtaaggttcttccaggacttgcagccttgacagaaaaataagattttataaataaatcaaagaagagagggatgaaagttcctcttttcttttgcttaaaataaaaacgcttcctctcaactattactcataaaaatcaccgatttatgataaaatggaaatagaaagttgagattatgagttattttaaaaaatataaattcgataaatcccagttcaaacttggtatgcgaacctttaaaacaggtattgctgtttttctagttctcttgatttttggcttttttggctggaaaggtcttcaaattggtgctttgacagccgtttttagcctgagggagagttttgatgagagtgttcattttgggacttcgcgtattctaggaaatagtatcggtggactctatgccttggtcttcttcttattaaatacctttttccacgaagccttttgggtgaccttggtagttgttccaatctgcaccatgttaaccattatgacaaatgtagccatgaataacaaagcaggggttattggtggtgtagcagctatgttaatcattaccctatcaattccaagtggtgagacaattttgtacgtgtttgtgcgtgtattagaaacgtttatgggagtttttgtcgcaattatcgtaaattacaatattgatcgtattcgtctctttttagagaaaaaagaaaaataatgttacattttataacattatcaattgacgtttgtctttttttagactataacagacagaaagaaggaaattgtaaatgaaggaaaaagaatttcgccgaaatatggctgtttttcctatcggcagtgttatgaagttgaccgatctatcggcgcgtcagattcgttattatgaagatcaagagttgatcaagcccgatcgaaacgaagggaaatcgtcgcatgtattccttgaaatgacatggatcgtctgcttgaaaatcatt

SEQ ID NO: 86 - DNA, 1249 bp; single-stranded, linear
aggcagtttcagactaatatccaagtcgtaagaaatgcctgaaataagcttttctaaattgtccaaagcttgcggaaaacgctcttggaatagtttctctaaagaacttgctgatataaaacatcttgtctccaacgcaactgtatttcatctgtcacgacgggaacacgggtataggtcatctgactgagcaagagggtcgcatgatccgcattgtgagtatcaatcaacacaactagatttttaacaggggtcaaaaaagtttcctcctgccccaacaagaaagtctcaaactccttggcaatcatcggctaaactccttggacaaacctggatacacctcgtgatctcgtgtcaaaaagtccactttgaagtaactatcatcaatctccacacgagcatagagacattctctgatggtacctcgtggttgactgatagagcctggatttagaaagaggatcttgccttccaaccaagcacttggcacatgcaagtgaccatagaggcagatagcggcctcttcctcctgagcccagtagtccaacttttgaaagttgaaattgatgtcaaacaagtgaccatgagtttggataatcttggtcgaaccaagctcagtcaccagacgttctgggtagccggcgtagaagtccatgttccctttaacaacgcggatgccctcccaaagtggagaatccggacgtagttcagaatcgccgttatgaaaaacggcatcgactttgcccacatagcgatcacggacttcttccacaatcaagctatcgccatgggaatcgctcattacaatgatggtttgctttgccatgatggaaatacctccaaaagtttcttaacggctaaggcacggtgagattgactatttttttcttccagggttaattcagctgatgactcacctgtctctcctacaaggaagaggggatcatagccaaagccattttcacccttaggttcaaagttaatataacctgaccagtctgcttcaacaactaaactttccttatttgggctggctacgactagggttgtgtggaactgagccgagcggtccttgagttcaaagaccatggccaattcgtgcaagagtttggcattattttcacggtcagtagctcccacacctgcgaaacgagctgaccagacgcctggtaagccaccaaggacntcgacttnagacnagattcactgccaaaaccatcttgnccgtcaatgagaantggtttctgcc

SEQ ID NO: 87 - DNA, 1990 bp; single-stranded, linear
ctagaccatttaacagtgatagggttaagacgagtgacatcaccccagatgattggtggttttaccccacggcataccgtatggattgtaaacccaatccaatttttaaggaggaaggaggtatcctgaacaagttttggaccggaagtaacttcaaaccaatgtcattaacggctcaaattcaaccgtggaaacaaggacatcaaagtcaatatcttcttgccaacttgaatccattcgtcaatcgtttcagcaagggaaagcatcgtactctttttgagacaattcacctttacggtaagccaaacgtttggcacgaacttcttttgtttgagggaatgaaccaatccttgttgttggaaaagctggaaatttgaaaccttctccttggatagcttcacgttctgcaaaggctggcaaacgagtgtagtctgcgtctgtcaagccagcgatacgcgcacgaagttcagcattttcaccaacacgctcagtcgcaaagagttctttgttggctgcaagagcttctgaaccttgaccattgcggatagcatccaagtcacggatttcatccaatttttcaactgcaaaggcaaagtggttcaagagtgctggttcaaattcttcattagcagttgtaaatggcacatgaagaagtgagcaagagcttgtcaaaacgatgttttcagctgggatttgctcaagaacagccaagctcttttcgtagttgttgcgccagatgtttttaccattgacaatacctacatagagagtcttgtcagctgggaagccacctttaacgagttcaagagttttcttaccttcaacaaagtcaagaccgatagcatctactggtaagtttacaaggtcagcgtatacgtcacgaacatcaccgaaataagtttgaagcaagacttcaagaccttttttgtcagccaagagtttgttgtaaaggttcaagaaaagagctttttcttcagctgtcaagtcttttacaagagccgcttcatccaattggatgcgagtcgcaccaagttcagccaatttagcaaaaacttcttggtaagcagccactaagctatctacgaagtcgtctgctttcacgccttcttcaaagtctgacaattgaaggaaagtgaagggacctacaagaacaggacgagtgttcaatccaagttctttggcttcttggaactcatcgaaaatcttgtgaccagccaattttacttgagtgtctttttcaaatttaggaacgatgtagtggtagttagtgttgaaccatttcttcattggaagggcgcgaacgtccccttttcctccctggtaaccacgtcccaaagcgaagtagcgctcaaggtcagacaagtccaagttttgaactgaggcaggcactacgttgaaaaggaaagccgcatctaggaagttatcatagtgagaaaagtcatttgatgggatttcagtgatgcctttccctttgacaatgttccagtgtttaccacgcaagtcttttgctgctgctaaaagttcttcttctgagatttcttttctaaagtatttttcagttgtaaattttaattcacggaattcgcccaaacgagggaaaccgatgattgtagttgacatgatgtgtcctccaaaatttgttgttgaaactatcttaacagaaaagaaagcgtctgtataattgtaaaaaattagggtttgatatagtttgaaactatatatctgtttcggacaaaagaaaaagacttgaagcaaacgtctcaaatcctttgtaattcttactttacagctatattccaattagaatactaaaacatgttattagtaattcttataagtgactatgacctgttattagaaaagactataactgattctagtcaactttttccctgttcaagtgggacgattgctagtgtctttcctaaactggctaggacttttaagactgtatccaactgaggactagtctttcctgtctccatcctag

SEQ ID NO: 88 - DNA, 1064 bp; single-stranded, linear
ctttataatnnacaannacttggatttgaacactgattacccatataatgagattaaaggagaggttaaagtatggccaaggatggaagtattcttcttcttcggaaagattttgttaagattaattaaaggaacctggcttaaaagggagccaaaagttcttttatccatcccgaaaaacaaatttttgaagcggttaaggatttatcgtttgaggttccaaagggacaaattttaggttttattggtgctaatggggcaggtaagtcaacaacgattaaaatgttgacagggattttaaaaccgacatctggtttttgtcgcattaatgggaagattcctcaagaaaatcgtcaggattatgttaaggatattggtgttgtttttgggcaacgcacccagctttggtgggatttggctttacaagagacatactcagttttaaaagaaatttatgatgtccctgatgcagtatttcaaaaacgcatggattttttaaatgatgttttagacttgaaagagtttattaaggatcctgtgcggacactatcattaggtcaacgtatgagagcggatattgcggcctccttgctccacaatcccaaagttctttttttagatgagccgaccattggtttggacgtttcggttaaggataatattcgtcgggcaattactcagatcaatcaagaggaagaaactaccattcttttgaccactcacgatttgagtgatattgagcaatttgtgatcggattttcatgattgacaaggggcaagagatttttgatggaacagtgagccaactcaaggagacctttggtaagatgaagactctctcttttgaactgctaccaggtcaaagtcatctcgtctctcactatgaaggtctgtctgatatgaccattgatagacaaggaaacagcctcaacattgaatttgatagttctcgctaccagtcagctgacattatcaagcaaaccctgtctgattttgaaatccgcgatttgaagatggtggatacggatattgaggatattatccgtcgcttctaccgaaaggag

SEQ ID NO: 89 - DNA, 1371 bp; single-stranded, linear
ctctagtgcctggtttggtagtgattttggttggggataatccagccagccaagtctaacgttcgcaacaaggagaggtcagctcttgcggctggttcccgtaccgaagtagtgcgagttccagagaccattactcaagaggaattgttagacctgattgctaaatataatcaggatccagcttggcatgggattttggtccagttgccattaccaaaacatatcgatgaagaggcggttttattagccattgacccagaaaaggatgtggatggtttccatcccctaaacatgggacgtctttggtctggacatccagtcatgattccctcgacacctgcaggaattatggaaatgtttcatgaatatgggattgacttggaaggtaaaaatgcggtcgtaatcggtcgttcaaatatcgttggaaaacctatggctcagcttcttttggctaaaaatgcgacagtaaccttggcccactcacgaactcataatcttgccaaggtggctgctaaagcagatattcttgtagtcgcaatcggccgcgccaagtttgtgactgctgactttgtcaaaccaggtgcggttgtcattgacgttgggatgaaccgagatgaaaatgggaagctctgtggagatgttgattatgaggcagttgcaccacttgctagccatatcacgccagtccctggaggtgtcggtcctatgaccattaccatgctgatggagcaaacttatcaagcagcacttcggacattggatagaaaataagagaaacattcgattaatagagtgtattttctatagctatatctaaaatggcagaaatgaatattaaattttagatataagattacaaaaggaggtctgcgtctcctttttgttgtataataaaagtgagagggaaaaaggatgaaagtgattaatcaaaccttactagaaaaagttattattgaacgttctcgttcaagtcataaaggagattatggtcgtctgctgctgcttggtggtacttatccttatggaggtgccatcatcatggctgctttagcagctgtaaaaagcggtgcaggattggtgaccgttggaacggacagggaaaaatatcccggctctgcacagccatttacctgagcctatggccttttctcttcaagaccagcaattgttaaaagagcaattggagaaggcagaagttatcttgctggggcctggtttacgagacgatgcttctggagaaaatctagtaaaacaggtctttgttaatttaagccaaaatcagattttgattgtagacggaggtgccttgaccattcttgctaggacaagtttgtcatttccctcaagccagtcaatccngccncccggggt

SEQ ID NO: 90 - DNA, 635 bp; single-stranded, linear
ttttgggggtntggctccttnggtnctttanaaaaggccctanggccntgatctgnaattcccattnntggctcntnanctaccatccgatttnncanggncccctnnctttccaatttnnttgttnanaatntggtcatccttggangtncactcgatganagtgattaatcaatccttattanannaagttattattgatcgtcctcgttcaagtcttaaaggagattatggtcgtctgccgcngcttggtggtanttatgggggcggaggtgncacctccatngctgcttgntcnggtgnnnnaancngtgcttgattggtgaccgtnggnnctnaccngnnttatttcccggctctgcacntcattnncctgaccctncggccatttctcttcaanaccagcnatngttnaangaccntntggnnaatgnngaattttntcttgctggggcctggatttactannacgatgcttccngnangaaaatntngttaaaacatggtctttgntnaattntaatcccnaattccaaattntgaatgtataacngaggtgccntngnccatccttgcnaagaanaatttgttnttttcccctcaanncaaaattgaaatnctggcncccngggggg

SEQ ID NO: 91 - DNA, 1505 bp; single-stranded, linear
ctcctgtggtaatagagaaaaaacttcctgaaacaggaactcacgattctgcaggactagtagtcgcaggactcatggccacactagcagcctatggactcactaaaagaaaagaagactaagtcttttcgataaaaaataaacagcgagattgaagctcgctgtttattttttaattaatcacctagtccaagacgttcaaagatatcatccactcgtttggtgtaataaactgggttgaagatttcatcgatttcttcttgtgtgagacgtgatgttacttctgaatctgcctcaagaagtggtttaaagtctacttggttgtcccaagagtaggctgtttttggttgcaccaagtcataggcttgctcacgggtcatgcctttttcaatcaatgtcaacatagcccgttggctaaagataagaccaaaagtcgagttcatgtttcggatcatattttctgggaagactgtcaagttcttgacgatatttccaaaacggttgagcatgtagtcaatcaaaatggtcgtatctggtgtgatgatacgctcagctgatgagtgagaaatatcgcgttcgtgccagagagcgacgttttcataagccgtaatcatgtgaccacgaatgacacgcgccagaccagtcatattttcagaaccgattgggttgcgtttgtgaggcattgctgaagaccctttttgccctttagcaaagaactcttctacttcgcgttgctcagatttttgtagaccacgaatctcagtcgccatacgttcgattgaagtcgcaatgctggcaagaaccgcaaagtactcagcgtgaaggtcacgaggaaggacttgtgttaaagattccttgggcacggatgccaagtttatcgcagacatactcctctacaaatggtgggatattggcaaagttcccaaccgcaccagaaatcttaccagcttctacaccagcagccgcatgctcgaagcgctccgatattgcgtttcatttcgctgtaccaagttgctaatttaagaccaaaggttgtcggctcagcgtgcacaccatgagtacgccccatcatgatggtgaacttgtgctccttggccttgtcagcgatgatattagtgaagttttcaaggtcacgacggatgatgtcgttggcctgcttgtagaggtaaccataagcagtatccaccacgtcggtagaagttaacccatagtgaacccacttgcgctcttcaccaagagtctcagaaaccgcacgcgtgaaagccaccacatcgtggcgcgtctcctgctcaatttccaaaatacggtcgatgtcaaagtccgccttcttgcgaatcaaagccacatcttccttagggatttcccccaactcagcccatgcctcgtcagagaggatttccacctcaagccaagcacggtatttattttcttcactccaaatattcgccatctcagggcgagagtaacggttgatcatgtgttaatttttcctttcttcttaagat

SEQ ID NO: 92 - DNA, 622 bp; single-stranded, linear
cggtggtgttggactggctgctccccagttagatatctcaaaacgcattatcgctgttttggtacctaatattgttgaagaaggcgaaactccacaggaagcctacgatttggaagccattatgtacaatccaaaaatcgtctctcactctgttcaagatgctgctcttggcgaaggagaaggttgcctgtctgttgaccgtaacgtgcctggctatgttgttcgccatgcccgcgttactgttgactactttgacaaagatggagaaaaacaccgtatcaaactcaaaggctacaactccattgttgttcagcatgaaattgaccacattaacggtatcatgttttacgatcgcatcaatgaaaaagacccatttgcagttaaagatggtttactgattcttgaataaagaaaatcccgttgcaagacggggttttgtgttataatagaggcatgaaaacaaatgatattgtctatggtgtccacgccgttaccgaagccctccttgcaaatacaggaaacaaactctacctccaagaagatctccgaggtaagaatgttgagaaagttaaggaactagcggtgacattttgaacaaataccaattttgaaattgttattc

SEQ ID NO: 93 - DNA, 1534 bp; single-stranded, linear
ctccacctcgaaacttaatcttagccagcaatcccttagaaacctcgtgcttttttaaaaaggtcttaaccttgacatgttcatctgcgataaattcaaacctcattcatccacctcaccgataaaggcatccttaacacggttccagaaactggtatggctaggagtcgcgacaaagtgaatcttatgatggtcgatttgatactcaatacgctcaatattacggaaagaataaacgctattgtcaaccgaaatagtatgataatcgtttcttgttggaataagttcaatcttatccttcttaggcacaataatggaagagcccagtgttcgataaacacgattattaaggctggcaatttccgttaattgcaaagcttcaatggtagggtgtaaaacagcaccgccaagagacttgttataggcagtactaccagtcggtgtcgaaactgttagcccgtctccacgaaaacgttcaaagggaacaccatttattacaatatctgccaccatggttcgatcagacctgcggatgctggcttcgttgagtgctctgaaaatcttaacttcaccattttcaagaaagaccttcacattcagaacagggtaagaaacccttgccccagtatctagctgcaaattagtcactagcttgtccaactcaaaatcacgataatctgtatagaagcccaaatgtccagtatgaagaccgataaagcggaccttgtcaagctgattttcgtacttatgaaaggccgacaagagcataccatccccgccaatggaaatgacaatatccggattggtatcattgagttataaactgatttctcttcaaacgatctcgcaattcatacaaaaccctttgactctgcggttttctattggctatcagatcaattcgtttacctgtattcttcatctgtatcgtcactgnntccaacaccgtcatttaattttctactcaaaggatcaaaaagtgcctgggcttcttggatatcatcacgaatttcacccatttcttcatccaactgatgggcgattctagctgtaatttccagtcgcttcttaatctcatctgggaaatccccttggtacttgtagttgagagaatgttctatcgttgcccagaaattcatggccaaagtacgaatttgaatttctgccaaaatagtcttagctccattgatggtatcaaccgtatattctactaccacatgataggaacgatagcctgatgcttttctatgagtaatgtaatctcgctcctgtatgattcgcatatcctgacgcttgtgcaaaatatccactacttccttgacgtcatctacaaactgaaccatcacacgtaagccagcaatatcctgcaaatcgtgttccaaggtcgcataagtaatgccacgacgagccattttttctttgatgctctcaattggcttgactcgaccggtcacaaactcaattggagaatgcttattttgcttacgatattgcttacgaataccacgaagtttaatctttaactcaccaacag

SEQ ID NO: 94 - DNA, 597 bp; single-stranded, linear
ctcgtaaaaacactaaaggaggtaaataaccaatgttagtacctaaacgtgttaaacaccgtcgtgaattccgtggaaaaatgcgcggtgaagcaaaaggtggaaaagaagtagcattcggtgaatacggtcttcaagctacaactagccactggatcactaaccgccaaatcgaagctgctcgtatcgccatgactcgttacatgaaacgtggtggtaaagtttggattaaaatcttcccacacaaatcatacactgctaaagctatcggtgtgcgtatgggatctggtaaaggggcacctgaaggttgggtagcaccagttaaacgtggtaaagtgatgttcgaaatcgctggtgtatctgaagagattgcacgtgaagcgcttcgacttgctagccacaaattgccagttaaatgtaaattcgtaaaacgtgaagcagaataaggagaaggcatgaaacttaatgaagtaaaagaatttgttaaagaacttcgtggtctttctcaagaagaactcgcgaagcgcgaaaacgaattgaaaaaagaattgtttgaacttcgtttccaacctgctactggtcaattggaacaaacag

SEQ ID NO: 95 - DNA, 1023 bp; single-stranded, linear
ctgcttatgattttcaagtttggactcgaaatcaatggcttccccgtgcttttaatgattggcgattcgttctcctagtttctgattggaagtttgggaattttccctgatttaggaaatgcgactattttagtcttggtttccttgattatgtatacagttagtggaatcgcttatcgctggttttcaaccattctggcactcgtatctgccacttctgtctttgtcttgaccactatcagcctaatcggtgttgagaccttttcaaaaattccagtatttggctatgtagccaagcgctttagtgccttttttaatccttttgccgatcgtgctgatgcaggtcaccagttagctaattcttattttgccatggtcaatggcggttggtttggtctaggtcttggaaactcgattgaaaaacgaggttatttgccagaagctcatacagactttgtcttttctatcgtgattgaagaatttggctttgttggtgccagtcttattttagctctcttgtttttcatgattttgcggattatcttggtcggtatccgagcggagaatcctttcaatgccatggttgcactcggtgtcggagggatgatgttggttcaggtatttgtcaatatcggagggatttcgggcttgattccatctacaggagtgactttccccttcttatcccagggtggaaatagtcttctagtcttatcagtggcagtagcctttgtcttaaatattgatgccagtgaaaaacgcgctaagttgtaccgagaattggaaaatcaaccaatgaaccttctgttgaagtaggataaagaaaggatagtttatgtctcttcaaaaattagaaaattatagtaataaaagtgttgtgaaagaagaagtcttgattctaacagaattactggaagatattactaaaaatatgcttgccccagagacctttgaaaaaataatacagttgaaagaattatcaacgcaggaagattatcaaggtctaaaccgtctagtgactag

SEQ ID NO: 96 - DNA, 779 bp; single-stranded, linear
ctggattgagaaaagataacaagctattctccactctccaattcatccatatcttgttcaaattttttctgagcccattcgccatagctcttaagaccaagattgccaataaagacccacggaaggtaaatgacataagtaatgacccaagcagacaggtatttaaaattcaaaggattgtgctgataaatttctatgttgaattgataattctgcaacatcaaaagagccgtaatagccaaggttaggaaaaaacaacccaaaatcgtaaaatgaaaacgactatagtaggtcactcccagataacgggcacgattgaaaaagtaaaatgtccctatgatgataacgattagcagcatattagaattaaaaaggcttggtgctaatactgaaatgatataagataggagcgacaaagcaatgcagatatagaaactttcagagcccgctttattgaacagttgttcttctctttcgtctagtaattgataataataaaatctatttttcatcttcttcctcccaaaatagttggtctagggttttccctaaacatctgcaaatagactggcagagcgagagactgggattgtattttcccgcctctatcaaaccaatagtctggcgtgtcaccccgacagcctctgccagttgaccttgtgttaaatcacgctctacccgagctaattttaattttaaatttttagccaccttcgtcctccttatagttttaatactcatctacgcttaaaaaatccaaaaccaacacaagctatcag

SEQ ID NO: 97 - DNA, 663 bp; single-stranded, linear
tcataaggaagctgtcgctcgttccgctaaggtatggacaccacggtgaacattggcattgtcctgctcatagtaactgttaatagctttcagaactactagtggtttttgtgtcgtcgcagcattgtccagatagaccagaggttcatcattgacaatctgatctaaaattggaaaatccttgcgaatcgcttctacatctaacataggcttccccttagcgttttgacaatttctcttcgatagttgcaatcatttcatcacgaacttccttgactggaatctccacgataacagatccaaggaaaccacgaacaaccaaacgctctgcagttgccttatccaatccacgactcatgaggtaatacatgtcttctggatcaacttgtccgatagacgctgcgtgtcctgcagtgacatcattttcatcaatcaaaagaattgggttagcatctgaacgcgcttggtctgaaagcatgagaacacggctctcttgttgcgcatctgctcccttagcacccttgatgatgtggccgataccattgaaagtcaaagttgctttttcaaggataaccccatgttgtaggatatttccgatagagttgcagccatagttagttacacgagtatcaatcccttgtacctgacgaccacttgaaagag

SEQ ID NO: 98 - DNA, 1426 bp; single-stranded, linear
ctcaagtttaaaaccaagcaagtcaaggacagtctctacaagattgctggaattgcagatgtagaagttgctgaaacgcttggtatggaacatccagtcaagtatcgcaataaggcgcaggtgcccgttcgtcgagtgaatggtgtcttggaaacaggatttttccgtaagaattcgcacaacctcatgccccttgaagatttctttatccaggatcctgtcattgaccaagtcgtagtagctcttcgagacctgctccgtcgttttgatttaaaaccttatgacgaaaaggaacagtctggattgattcggaatcttgtggtgcgtcgtggtcactattcaggacaaatcatggtcgttttggtgacaactcgtccaaaagtttttcgtgttgaccaattgattgaacaagttatcaagcagttcccagagattgtgtctgtcatgcaaaatatcaacgaccagaataccaatgcgatttttggtaaggagtggcgcactctttatggtcaagactatattacggaccagatgttgggaaatgacttccaaatcgctggcccagccttttaccaagtcaatactgaaatggcggagaaactctatcaaacagccattgactttgcagagttaaaaaaagatgatgtggttattgatgcttattctggtattggaaccattggtttatcagtcgccaagcatgtcaaagaagtctacggtgttgaactgattccagaagcggttgagaatagtaaaaaaaatgctcagctgaacaatatttcaaacgcccactatgtctgtgacacagctgaaaatgctatgaagaattggcttaaagatgggattcaaccaaccgttatcttggttgatcctccacgccaagggcttgacagaaagctttatcaaagcaagcgcccaaacaggagccgatcgcatcacctatatctcctgcaatgttcgcaaccatggcgccgttgatattaaactataccaagagttgggatatgaattgaagaaagtccagccggtggatctatttnttcaaacgcatcacgtcgagacggtagcacttttgtccaaactcgatgtcgataagcacataagtgttgaaattgagctggatgagatggatttgacaagtgcggagagcaaagcaacatatgctcaaatcaaagaatatgtttggaataaatttgaattaaaagtttcgacattatatattgcacagataaaaaagaaatgtggaatagaattacgagaacattacaacaagtntaaaaaggataaacaaattattccacagtgtacacctgaaaaagaagaagccatcatggatgctttgagacanttcaaaatgatttaatagaaaagaatgacagtatatgactttctgcatttattacattcctacttggtataggaacag

SEQ ID NO: 99 - DNA, 991 bp; single-stranded, linear
ctctgacggaggctggttatgtgggtgaggatgtggaaaatatactcctcaaactcttgcaggttgctgactttaacatcgaacgtgcagagcgtggcattatctatgtggatgaaattgacaagattgccaagaagagtgagaatgtgtctatcacacgtgatgtttctggtgaaggggtgcaacaagcccttctcaagattattgagggaactgttgctagcgtaccgcctcaaggtggacgcaaacatccacaacaagtagatgattcaagtggatacaaaaaatatcctcttcatcgtgggtggtgcttttgatggtattgaagaaattgtcaaacaacgtctgggtgaaaaagtcatcggatttggtcaaaacaataaggcgattgacagagaaacagctcatacatgcaagaaatcatcgctgaagacattcaaaaatttggtattatccctgagttgattggacgcttgcctgtttttgcggctcttgagcaattgaccgttgatgacttggttcgcatcttgaaagagccaagaaatgccttggtgaaacaataccaaaccttgctttcttatgatgatgttgagttggaatttgacgacgaagcccttcaagagattgctaataaagcaatcgaacggaagacaggggcgcgtggacttcgctccatcatcgaagaaaccatgctagatgttatgtttgaggtgccgagtcaggaaaatgtgaaattggttcgcatcactaaagaaactgtcgatggaacggataaaccgatcctagaaacagcctagaggtgactatggaacttaatacacacaatgctgaaatcttgctcagtgcagctaataagtcccactatccgcaggatgaactgccagagattgccctagcagggcgttcaaatgttggtaaatccagctttatcaacactatgttgaaccgtaagaatctcgctcgtacatcaggaaaacctggtaaaacccag

SEQ ID NO: 100 - DNA, 1140 bp; single-stranded, linear
ctggcttggctctgattgtcaataaaggaggttgatgttgataacctaacgacagagcaacttcgtcaaatcttcataggtgaggtaaccaattggaaagaggttggtggtaaggacttacccatctctgttatcaatcgggcagccggctctggctctcgtgctacctttgatactgtcattatggaaggtcagtctgccatgcaaagtcaggagcaggattcaaatggagcggtaaaatcaatcgtatcaaaaagtccaggagctatctcttatttatctcttacctatatagatgattcggtcaaaagcatgaagttgaatggctatgacttaagtccagaaaatataagtagcaataattggcccttgtggtcttatgagcatatgtatacattggggcagcccaatgagttggctgcagaatttctcaattttgttctctcggatgagacccaagaagggattgtcaaaggattgaagtatattccgattaaggaaatgaaggttgaaaaagatgctgccggaactgtgacagtgttggaagggagacaataatgaatcaagaagaattagctaagaaaatgttgcttccatcaaagaattctcgtctggagaaattaggaaaaggtttgacctttgcctgtctttctttgatagtcatccttgtggccatgattttggttttcgtagcgcaaaaaggcttgtcgaccttctttgtcaatggtgtgaatatctttgactttcttttgggaggaacttggaatccttctagtaaagaatttggtgcccttcctatgattttgggttcctttatcgttaccattctctcagcccttatcgcaacaccctttgctattggtgcagcagtttttatgaccgaagtatcaccaaaaggggcgaagattttgcaaccagctattgaactcctggttgggattccttcagtagtgtacggatttattggcttgcaagtcgtcgttccctttgttcgcagtgtctttggtgggactggttttgggattttgtcagggatttccgtcctctttgtcatgattttgccgaccgtaacctttatgacaacggatagcttgcgtgcggttcctccnttattatcgtgaagccagtttcgctatggga

SEQ ID NO: 101 - DNA, 1155 bp; single-stranded, linear
ctgggactctcttcgtagaagtcatgcaagaatattttgatcaaaagaggaaatcatgaaaaaaagagcaatagtggcagtcattgtactgcttttaattgggctggatcagttggtcaaatcctatatcgtccagcagattccactgggtgaagtgcgctcctggattcccaatttcgttagcttgacctacctgcaaaatcgaggtgcagccttttctatcttacaagatcagcagctgttattcgctgtcattactctggttgtcgtgataggtgccatttggtatttacataaacacatggaggactcattctggatggtcttgggtttgactctaataatcgcgggtggtcttggaaactttattgacagggtcagtcagggctttgttgtggatatgttccatcttgactttatcaactttgcaattttcaatgtggcagatagctatctgacggttggagtgattattttattgattgcaatgctaaaagaggaaataaatggaaattaaaattgaaactggtggtctgcgtttggataaggctttgtcagatttgtcagaattatcacgtagtctcgcgaatgaacaaattaaatcaggccaggtcttggtcaatggtcaagtcaagaaagctaaatacacagtccaagagggtgatgtcgtcacttaccatgtgccagaaccagaggtattagagtatgtggctgaggatcttccgctagaaatagtctaccaagatgaggatgtggctgtcgttaacaaacctcagggaatggttgtgcacccgagtgctggtcataccagtggaaccctagtaaatgccctcatgtatcatattaaggacttgtcgggtatcaatggggttctgcgtccagggattgttcaccgtattgataaggatacgtcaggtcttctcatgattgctaaaaacgatgatgcgcatctagcacttgcccaagaactcaaggataaaaagtctctcccgcaaatattgggcgattgttccatggaaatctgcctaatgatcgtggtgttaattgaaacgcccgaattggcgaatgaaaaagaaccttaagaaaccaggtggtaactggctaaagggaacccggcatgaccccttttccccttcttggaacgccttggcgaat

SEQ ID NO: 102 - DNA, 1030 bp; single-stranded, linear
ctaatccaattgtggctggtgctcttgccatgacagcaggttattgtgggaccttattgaccccaatggctgctaattttaacgctctaccagcagcattgatggatatgaaagatcagaatggcgttataaaggctcaagcaggtgttgctctagtaatgattgttattcacatattcttaatgtactttctcgcattttagtaaaggaaaataaaatgaaaatattggttacaggttttaatccttttggaggtgaaaagattaatccagctttggaggctgtaaaattattaccatctgagattaatggggctgaagttcgctgggtagaaattccaacggttttttataagtcgtcagaagttttagaggcagaaatattacgatatcaaccagatgctgtactttgtattggacaagcaggcggcaggaccggcttaacacctgaacgagtggctattaatcaagatgatgctcgcatacctgataacgaaggcaatcaaccaattgatacaccgattcgtattgatggagcatcggcctattttagtagtttacctatcaaagcgatggtacaagctatcaaaaaacaaggacttccggcagttgtatccaatagtgcaggaacctttgtttgcaatcatttgatgtaccaagctctctatttagtagataaagaaattccctaatatgttaagagcaggttttcatgcatattccatatatgatggaacaagtagtgaacagaagccgaatactccagactatgagttctatgtggatattcggcgtaaaggcatagaagcagcaatcggcgctatgatagaacatggagatcaggaactcaagttggtaggcggagaaattcattgatagaaaaaagcttgaggggaaaaccttcaagcttttggacgttttcgagccaatactgctcggtaaaacataattttagtgcattggatataaggtaggagtgaaaaactagcaatgccaaaggtaatccaattgaggaagtaccaaggaagaag

SEQ ID NO: 103 - DNA, 584 bp; single-stranded, linear
ctgtaaaagaagttaatcaagttgataaagcacttttaaaacaaattggtgcagttgatgtcttagaagtgaagggtggcattcaagcaatctatggagcaaaagcaatcttatataaaaatagtattaatgaaattttaggtgtagatgattaagtacttactgacttaataaaaaacagaggagagtgatggatgagtaggatgaaatgaaatcgcatacaagaaataaagaactcattatccaagttggatacgcttattacataggagaatacaaatgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgttttgaaaaagcaacccagatataaaagtgaaattggaaaccatcgacttccagtcagtcctgaaaaatcacaacagccatcgaagcaggaacag

SEQ ID NO: 104 - DNA, 957 bp; single-stranded, linear
ctggaattaaaacgcacgagtattgcacgaataaccaaccaaacaaccactcagaccatgtggatccatacccttacttggcaaaatggggcattagccgtgagcagtttaagcatgatattgagaacggcttgacgattgaaacaggctggcagaagaatgacactggctactggtacgtacactcagacggctcttatccaaaagacaagtttgagaaaatcaatggcacttggtactactttgacagttcaggctatatgcttgcagaccgctggaggaagcacacagacggcaactggtactggttcgacaactccaggcgaaatggctacaggctggaagtctccaactcttctcttttttaatacaagctattttgatttaaccggctggtcttgagctgtctgcaaagctgtggcaatcgtatctgcatacaattttgctcctgcttcgatagtgctactctcactcccgaaatgaacctggtctgttccagcccaaatttctggatgctctttcgcaacttgattccaatctgctatcgtaatgtaaggtgtcttctctgccaattctctcatataggcagcagccttctcaacgatggcataggtctcttttgtcttatctccctcataaggagtcaccaaaatcatatggtgtcccttaggaagatttttcacgatactgtcccagtcatccttgtaattctcaggattatttaccccagtcgcaatgaccaccgtcttaggtaaaaatttattctggctattatttagcatgatttcatttgcggtcttggttgttacgctgacctgcgcgttaatctgtgctccaggaagagctgtctgtagtgctgtatttgcccttaaagccactgagtcaccaattaacatagtgccatcagcaattcccaaactgtttgcatctgcccgttctgccatcaccttggtctgg

SEQ ID NO: 105 - DNA, 1568 bp; single-stranded, linear
ctcgtgcgacgacagatgttattcgtcatggtgcaccaaaggcagagattgaggggcttttctcagttgagaatagtcgtcttttacaggaaatttttgatgagcaaggtttagaattaggtgatgaaattatcatccgtcgggaaatcttgcaaaatggtcgtagtatcagccgtgtaaatggtcagatggttaatctgtctgttttgcgagctattgggcaacatcttgtagatattcatggtcagcatgaccatgaggagttaatgcgtccccaactgcatatccagatgttggatgaatttggtgatgccgctttttgggacttgaaagaaacctatcaaacgagttttgatgcctatcggaaaatgcgcaagcaggttctggaagtcaagaaaaaccaacaggaacacaaggcacgtatcgaaatgttggaatttcaaatggcagagattgaggcagcaaacttgcaggctggagaagacttggctctcaatcaagagcgagataaactcctcaaccacaaaaatattgcggatacactgaccaatgcctacagtatgttggacaatgaagatttttcaagtctggccaatgttcgttcagctatgaatgacatggaaagtgtcgaagagtatgatcctgaataccgtgaaatttcaagctctctgtctgagacctactatgttttagaagacattaacaaacgtttggaagctatcattgaggaccttgattttgatggcaatcgcctgatgcaggttgagaatcgtttggacctccttcatactattactcgtaagtatggtgggactgttgatgatgttttgctttattttgccaagattacggaagaatacaatctcttgacaggcaataatctttccgtctgaggacatggaagcagagcttaagaagttggaagtcaatcttgtcaatttggcaggtcaacttgcttctgctcgtcataatttggctcagcaactcgaagctgagattaaacaagaactgcaagatctttatatggaaaaagcccagtttcaggttcgttttagtaagggaaaattcagtcgtgagggaaataaaatggttgagttttatatttcaaccaaccctggagaagactttaaacccttggttaaggttgcttctggaggggaattatctcgtctcatgttagccattaagtctgccttttcacgtaaagaaggcaagactagcattgtctttgatgaggtggaaacgggagtttcaggtcgtgttgctcaagctattgctcagaaaattcataaaattggtcagcatggtcaggttttggctatctcccatttgccacaagtaattgcgattgcagattatcaattctttattgagaagattagtaatgaccattcaacggtttcgactgttcgtctcttgacggtcgaagagcgagtggaggaagttgccaagatgttggcaggtgatgatgtgacagaagcagccctgacgcaagccagagaattgttgagaaacagggagaaataagatgacagattattatgtaattggagatgttctcggaaaag

SEQ ID NO: 106 - DNA, 653 bp; single-stranded, linear
ccaaagggtcaggagaccagccagaaattgtggaagtgtcaccagatgcccttattccttacgctgcagtggtaccgcatcaggcagaggtcatttttcgccagcgctttgagatgacagacaagggaattgaaagaacgaattgagtcttattatgatgggggaaaatcttttccgctctatcaagattcggggggaatttttacatatgcatgtgcgtatgattcctaagtcaacacccgataccaagtttgctgatgtcgcaacccatcaaccggaatatagtcgtgacaatgttgcggggactattgttggtttctggacgcctgagattttccatggggtcagtgtggcaggctaccatctgcacttcatatcagatgatttgaccttcggtggacatgtcatggattttgtcatcaaggaaggcattatcgaggtgggagcagttgaccagttggaccaacgtttcccagtccaagaccgtcaatacttgtttgctaagttcaatgttgacgagatgaaaaaagatattgaaaaggcagaataggagaagaaaatgaccattcatatcattattaccatgttgctgttgctagcttttctgataggaagcatttggtttgccaaaaagaaatatcagattaatctag

SEQ ID NO: 107 - DNA, 708 bp; single-stranded, linear
ctattattgcaaggtnntgaagtcgaacgaaaaaattactctagtccttttgatttggaatgtcatcatttccttgatttatggaattgacatattcaaggcaagaaaaagagcttggcgcatcccagagaaaatcttactcatattaccccttacttgtggtggtttgggggcctggtttagctggaatcacttttcaccacaagactcgaaaatggtactttaaaacagtttggtttcttgggatggtgaccacactagtagccttatattatatttggaggtaatggatggcagggtcttcgagggaccacgctgcttgggctctagcggactatggttttaaggtcgtgattgcaggatctttcggtgacattcattacaataatgaactcaataatggcatgttgccaatcgttcagcctagagaggttagagagaaactagcccagttaaaaccaaccgaccaggtaactgtggacttggaacaacaaaaaatcatctcaccagttgaagaattcaccttcgagatagatagcaagtggaaacataaactcctaaatagtttggatgatatcggtattaccttgcagtatgaagagttgattgctgcttatgaaaaacaacgaccagcctactggcaggattagaaaaaatagaaaaggaaatatagtaaactgaaataagatgtaaacaaatgaattggag

SEQ ID NO: 108 - DNA, 1381 bp; single-stranded, linear
ctcgtgttgtggacgagttagacatacccgtcatggcttttggcttgaaaaatgactttcgcaatgaattgttcgaaggttccaaatatctcttgcttttagcggacaagattgacgaaatcaagaccatctgtcagtattgcaagaaaaaggcgaccatggtgttgcgaacacaggatggactgcccgtttacgatggagaacagatccagattggtggtaatgaaacctatatctcggtttgccgtaaacattattttgcccctgaaatcaataaggagaatgaagaaaaatgaacatctatgatcaactacaagctgtagaagaccgttatgaagaactaggagaattgctgagtgaccctgatgtcgtttcagacaccaagcgttttatggagctttcaaaagaagaagcttcaaatcgtgacaccgtaatagcctaccgtgagtataaacaagtccttcaaaatatcgtcgatgccgaagagatgattaaggaatcaggcggagatgcggacttggaagaattggccaagcaagaactcaaagatgccaaggctgaaaaagaagaatatgaagaaaaactgaaaattttgctccttccaaaggatccaaacgatgacaagaatatcatccttgaaatccgtggagcagctggtggagacgaagcggcacttttcgctggagatttgctaactatgtaccaaaagtatgcggaagcccaaggttggcgctttgaagtcatggaagcctctatgaatggtgtcggtggttttaaagaagtggttgctatggtttcaggtcagtctgtatactctaagcttaagtatgaatcaggtgcccaccgtgtgcaacgtgttcctgtgacagaaagccaaggccgtgttcatacttcgacagcgacagttcttgttatgccagaagttgaagaggttgaatacgacattgatccaaaagaccttcgtgtcgacatctatcacgcctctggtgctggtggacagaacgtcaataaggttgcgactgccgttcgtatcgttcacttgccaaccaatatcaaggttgagatgcaggaagaacgtacccagcagaagaaccgcgagaaggctatgaagattatccgtgcacgcgtcgctgaccactttgctcagattgctcaggatgaacaagacgctgagcgtaagtcgacaatcggtactggtgaccgttcagaacggatccgaacttataacttcccacaaaaccgtgtcacagaccaccgtatcggcttgaccctccaaaaactagatacgattttgtctggtaaattggacgaagttgtggatgccttggtgctttatgaccaaacacaaaaactagaagaattaaacaaataatgaaattag

SEQ ID NO: 109 - DNA, 1276 bp; single-stranded, linear
ctcccatttgcgatactgggatacctgtcattcgttccacagattcagccacatcgttgacacttgcagtcactttcatatcttctgtgtggttttcgattttcctttccaattctgcaatgcgtgttttatagtttagagctgcttcaaaatcttctgcttcaactgctttttcttgcttgtctttttccgtttcgatttctcgttcaacagcatgcacatctgttactggatgttgagccgccaagtgagcagccgttacatcgacaaggtcaatagccttatctggcaagctacgttgaggaatgtattgaacagaataatccaccgctgctttcaagacttcgtctggcaagatgacattgtggtgttgttgatagaggtcacgaatgccttgaagaattttaaaagtattctctgctgaaggagcattgaccttcacttcgttgaaacgacgagcaagagcagcattcttcaagaaggtgttacggtattcgtcttgagttgttgccccaatcactgtcaattctccacgagagagactggctgagaatatccgcaagccctttagaaccactgtctccacaagtgctaccagcaccaagaattgtgaatttcatcaaagaagaggataatattccctgcttctttcacttcattgactaagttttggacattttcttcaaagctaccacggtattgagtaccagcctcaagacctgagatatcaatagaaataatttccttgttcttgatagcagcaggaacatctccgttcacaatggcttgcgctagaccttcgacaactgctgtcttaccaacacctgcatctccgaccaaaacaggattgttcttggtgcggcgtgagaggatttcagatgtttcttgaatttccttgtttcgtccgataacaggatccaacttgccctcacgcgcttctgctgtcaagtttcgacctagttttgcaaggacaccgtcttgtttcatacctgatgcctgttgtggcatttgcacatcagtttctgcatttcctggtaattgaccagtcgtacgatagtgagcaaattcctcaggtgtgacttcgcgtccattaattaagtaacggcgattttcagaactgtatcctcgcataccacccatcaattggttaaataaatcatccatgttattaaaattattaaagttgttattcatattctttacctctttttgtttacttagttatgattactgatattgactatctttgacctttgttttaaaaaatttagactag

SEQ ID NO: 110 - DNA, 1234 bp; single-stranded, linear
cttggcagaatttgccggtctatcagacgcacttaaagggcaaggactctaagtatgcagggacaaatcattaaagccttggcaggtttctactatgtggagagtgatggccaggtttatcaaacacgcgcgcgtgggaatttccgtaaaaaaggccataccccttatgttggggactgggtacatttctctgccgaggaaaattcagaaggctatatcctaaaaattcacgaacggaaaaacagtctagttcgtccgcctattgtcaatatcgatcaacctgtagtaatcatgtccgtcaaggaacctgattttaacagcaatttgctggatcgtttcttggttcttttggagcacaagggcatccatcccattgtctatatttccaaaatggatttgttggaagataggggagaactggatttttaccggcagacctatggtgacatcggctatgactttgtgaccagtaaagaggaactcctgtctttgttaacaggcaaggttacggtctttatggggcagacaggtgttgggaagtcaactcttctcaataaactcgtaccagacctcaatcttgaaacgggagaaatttcagacagtctaggtcgcggtcgccataccactcgagctgttagtttttacaatctcaacgggggtaaaatcgcagatacaccaggcttttcatctctggactatgaagtatcaagggctgaagacctcaatcaggctttcccagagattgctactgttagccgagattgtaagttccgtacttgtacccatacccatgagccgtcttgtgccgtcaaaccagctgttgaagagggtgttattgcaaccttccgttttgataattacctgcaattccttagtgaaattgaaaatcgtagagaaacctataaaaaagtcagcaaaaaaattccaaaataaggagaaacctatgtctcaatacaagattgctccgtcaattctggcagcagattatgccaactttgaacgtgaaatcaaacgtctagaagcaactggggcagaatatgcccatatcgatatcatggacagtcattttgtaccgcaaatcagttttggtgcaggtgtggtcgagagccttcgtcctcatagtaagatggttttcgattgccacttgatggtgtcaaaccctgaacatcatctggaaaaattttgcgcccgttgcagggttgcaaaaaattcatccagttatcccatgtttaaa

SEQ ID NO: 111 - DNA, 945 bp; single-stranded, linear
ctcttaagaccaattccgagttacttcttcatcagcctttaaccgatccactaattggtcaactgagtcaaatttggtcatatctcgaatgcgatcaagccaataaaccatgacggtttccccataaatatcttgattaaaatcaaaaatattgacttcaaaacgtgcttcttctccatcaaaggtcacatttttcccgacactagccatagcacgatacttctgtctttgaatctcaacatcaacgacataaacgccatctgctggcatataagtacggtctaaaagcactaaattcgctgtcggataaccaattgtacgaccacgagcattaccatgaactaccatacctcttgatggaagcggtgcccccaaaagttttcctgcttctttcacatttccatctaaaatagcttgacggatacgagttgaactaatctttcctttctcatcttctacaggtggaacaatgataacttctccatcaaagtaatcctttaaatcttctgctgtttttttgtcagaaccaaatgtataatcaaaacctgcaacaataattttggcattcatagccttgatataagttgcaaagaattcttgtgcagtgagactagcgaattgactactaaaatcaaggagatataattcttctacaccttcgcgctttaattttctttcacgttcagcagggttcaaaatatgcaaaaacaaatctggatgataaggctctaaagcgatctttggagattcattaaaggtcataacgacgataggcaataaatcctttctcgcagccttgttggcaacacgaaataattcttgatgccccttatgtatgccatcaaaatagccgagaacaacgactgaatcagatggtgtgccaatatctttttggttttttataggaatagtaataatcataaaataattatatcatagcgatag

SEQ ID NO: 112 - DNA, 853 bp; single-stranded, linear
ctattttaaaaggagaattggcagatggcgactactgagttgattgaactggcaattgaaaccagcaaacatgcctatgtcccctattctcactttcctatcggagcagttttagtagccaaagacggaaatgtttacacgggagtgaatatcgaaaatgctagctatcctttgaccaattgcggtgagagaacagctatttttaaggctatatctgaaggccaaagagaattttcagaattgattgtctatggtcaaactgaaaaaccgatttcaccatgtggtgcttgtcgccaagtaatggtcgaattttttgaacaagatttaaaagtgaccttagtcgcaaaagataaatcgacggtcgagatgacggtcggggagttacttccatattcttttacagacttaaattagtctgagtcgctctttgagtggcaagggtctttgtgaccaatcaatccatacttgcaacatcgttgcacatcttatttaggaggttcagtaatgaacaagaaacaatggctaggtcttggcctagttgcagtggcagcagttggacttgctgcatgtggtaaccgctcttctcgtaacgcagcttcatcttctgatgtgaagacaaaagcagcaatcgtcactgatactggtggtgttgatgacaaatcattcaaccaatcagcttgggaaggtttgcaggcttggggtaaagaacacaatctttcaaaagataacggtttcacttacttccaatcaacaagtgaagctgactacgctaacaacttgcaacaagcggctggaagttacaacctaatctttggtgttggttttgcccttcacaatgcagttgaagaagcag

SEQ ID NO: 113 - DNA, 1007 bp; single-stranded, linear
ctcagctacttcgcctttctttttattctactggtttttcttgatttccagtagttgtagaagattctgttgttttattttctgaagttgattcagcaggtttagaatctcttgtattgcttggtttgttttcgtcgctagcagtttcaatgttagattctgcagttgcgtttggttggttctcagcactggtgttatcaccatttgcttcagcatttcttgctggacttgtttcttcacttgcgctagcttttgactggatttgatgattcaaaactagaatagcttttgtcgattcaagtaaagctgttttgtctttactattagcagaaagttgatctaataatgcatccaccttatcaaaagtccgcatcagatccattattactttctaaataaaagtgaagcgacatgagaatatcgtagagtttttgatagagtacaagtgtctgaggatcttgctcagcattttccttttcttgttgaagggcgctagcgatacgagtcaagacatcttttacctgactgtttacttcatccaagtctgcatcagccttgtttgtggcagcttttagattttctacttcttctgccaaagattgtctgattccttcttcatggattcgttccaagagttgatttgccttgctcaaaagactttctacttcttccttgctatctgtcgcagattattggttgctatctaccatgtactcctaaaacaggagagttataatccaagattacaaggccttacagaaataagaaatccagataagacaatgttcgtccaagacgctattcgcttcgcacagcagcacggattcaatatgctttaattttaaagtttaggtgtcaagacctctttttagtgtgcccaaaatttagagaagtaatcaatcaactaacttttatttttttcaaactttcagtaaactgacctaaagctaactcaatctgtctttgttcgataggcttgtctttgtagatgcttctgctatcagatc

SEQ ID NO: 114 - DNA, 896 bp; single-stranded, linear
ctcattcagagcttgaaaatgcagcctgtgtcgtgattgggacagggattggcggagccatgattatcaatggtagacttcatcgaggtcgccacggcttgggtggagaatttggctacatgacaacccttgcccctgctgaaaaacttaataactggtcgcaactagcgtcaaactgggaatatggtacgatacgtgattgaaaaatctggtcatactgattgggacggtcgcaagatttaccaagaggccgcagctggtaatgctctttgtcaagaagccattgagcgcatgaaccgcaatctggcgcaaggcttgctcaatatccagtatctcatcgatccagatgtcatcagtctgggtggctctatcagtcaaaatccagattttatccaagatgtcaagaaggctgttgataactttgtcgatacctacgaagaatacacggtcgcaccagttatccaggcctgcacctatcacgcagatgccaatctctacggtgctcttgtcaactggctacaggaggaaaagcaatggtaagatttacaggacttagtcccaaacaaacgcaagctattgaggttttaaaaggtcacatttctctaccagatgtggaagtggctgtcactcagtctgaccaagcctctatctctatcgagggtgaggaaggtcactatcaattgacctaccgcaaacctcaccaactctatcgtgccttgtccttgttggtaacagttctagcagaagctgataaaatagagatcgaagaacaaggcagcttacgaaaattggcttacatggttgactgttctccaaatgcggtgctgaatgtggctttcctgccnaagcagatgactgaaggtcttggctctcntgggctactccaccctttgaag

SEQ ID NO: 115 - DNA, 594 bp; single-stranded, linear
ctagcaacaagnggngctaaaatcaaggttaccttatcgccgacaccaccagtagaatgcttgtcaactttcacaccatcaatggctgacaggtcaaactcttgcccagtcttaaccatattcatcgttaaatcagagatttctcgagtcgtcattcctttaaaataaacagccatagcaaaggcagacatctgataatcaggaacagttcctgatacatagccttctatcagccattcaatttcacttgaagtcagttcttgaccgtctcgttttttttggattaaatcaactgctctcattctttcacacttctaaggatatagtatcctttgtcttttttaaggatttcacaattaccaaacacatcctccatcttggacttagcacttggagccccttgttttttctggatgacgattgtcaaatccccaccagtttccaagaaatctttacttttctcaatgatttcatgaacgacttgcttgcccgcacggataggaggattggaaatgacatgatcaaaatgtccttcaacttgttcatagatgttggactggaaatctccttgcattatttttcacattctccaag

SEQ ID NO: 116 - DNA, 643 bp; single-stranded, linear
ctagtgttttatagcctgtttctttcacaaattgagcaaattcttgattcgtaactggagtatccgcaatggaaaaatcctttacactaacagcgacttgaggaccttcaaaatcatctaaaaagccctcttcagaatttgttcccatcataaatgtcccacccttgatttttttcattttcatgattgactatcccccgttttcgttagagttggcgttattttagaaagttcaacaggaactaactcttcatccacaacaaaaccttcttctctatatctaagaaagtctactaattttttcttcatctgacgaacaataggttgatatttttcacttggatacaaatcattcatttcatgcggatcttttttcatatcaaataactgataatgatttaaaacaggaaaccagataaatttccactggtctgtcaaaatatattgactagaatcttttcctaaagcatgttcaccatgaaattctgttcgccacccctcgtactgtccaaataataaattccttaacactccgtccatctagttcatctgtagtagttcctccctgccaaatccacgaagtgaaggaaaaatatcttgaattttcactaattgcttgattgttccctattaccagatcgan

SEQ ID NO: 117 - DNA, 1077 bp; single-stranded, linear
ctgttctcaatcatattgtcagtcgctttgatatcattggtatccttggtaacggggccgattttgccattcttgagcaagccagcgtcccaagattgtgatatctttatcgccctgactgagcacgatgaagtcaacatgattgcagcagttctagccaagaaaatgggagctaaagaaactatcgttcgggtgcggaaccctgaatattctaactcttatttcaaggaaaagaatattctcggtttttctcttatcgttaatcctgagctcttggctgcccgcgctatcgcgaatatcattgacttccccaacgccctgtctgtcgaacgctttgctggtggacgcgttagcctcatggaatttgtcgtcaagtccaccagcggtctttgccaaatgcccatttctgattttcgtaaaaaatttggtaatgtcattgtctgtgcgatagagagggatcatcaaattatcattccaagcggtgacatgactgtacaggataaagatagaatctttgtcactggtaaccgtgtcgatatgatactcttccataattattttaaatcacgcgccgtgaagagccttctcatcgttggagcaggtagaattacctattatctacttggtattctcaaagatagtcgtatcgatacaaaagtcattgaaatcaatcctgaaatcgccagcttctttagcgagaaattcccaaatctctacatcgttcaaggagatggaaccgcaaaagatatcctgctggaagaaagtgctcaacactatgatgccgttgcgactctaacaggagtcgatgaggaaaatctgattacatctatgttccttgacagggtaggtgtacagaaaaatattactaaggtcaatcgtaccagtctcctcgagattatcaatgcgcctgatttttcaagtatcatcacacctaaaagcatcgctgtagatacgattatgcactttattcgtggtcgagttaatgcccagtattcaagaccttcaagccatgcaccatctagccaatggccaaatcgaaaccctgcaattccatatcaagggaagccaataaaatga

SEQ ID NO: 118 - DNA, 1499 bp; single-stranded, linear
cttgaatggcagagcattcagcgtagtctcgcccccaactataaggagagaagtcagggtgaaagtttccttgattgtctcgtgctcgcatgtaacctgtctcagcgtcaaatagctggcggtaattttgtgaagcagccttgtaggtttcagcgatttctatgttctctagttttttggcacagctggcgatacaaaagtcactataggcatagtctagagtatggctaacactttcgtggtggtcggtagagaggtaacctagttcttggtattgggctagtccgtggcggccattgattccgagagggtcggctttgctggctgtttcggagcatggcttggaagagttctccttctaggtcaggggccatgtccttgcaggcgctatctgcgataataccgtctaaaagtgtacctggcatcataccccgttcatctggagccagccattttggaaggaaaccagtatcgcggtagctattgaggaaaccttctaaaaagcgttgatagtgctccggtatgataagggcaaagagggggaaggtggtgcggaaggtatcccagaaaccattgttgctaaagaggacaccaggcttgacagtaccagtagccagatccatgtggatggcttgccctgattcattaatctcataaaaagtctgtgggaagaggaagagtctgtagaggcagtggtcaaagaaggttcggtcagcctctcctatctctataatgtcaaaacgatggaggagattttcccaatccgcttgggcacttgatttacagctatcaaaatcttcttgaggtagattaagcagtgcttgagaaggagagatgaaagaagtggctagttgcatctcggtttgactacttgctaagtcaattcgccagtctccaacttcttggctgatagcaagaatatccgtgttcatttgcagggcagtgaagagcatcagtggatttttattggtctctgttttgccttcttgtctgagagccagagtccgcttatctacctgctcaactgttagttcatctgctgcgtgaagatagagggagaagggctttgccttgcttttgcttcaaacgaatagaagcaccatagcaagtcggtgtgagctgggtttcaatttgatagcgcagggaaaagagcttcaaatagtgaggctggaagcaagctttatctatatcataagaagactggcggtgaaagaggctgtctccacccagttgactggtgacaggtgtcagaaggagccaagagtagtccccaatccaaggactgggctggtgagttaatcgaatcccctgaaagataggcagatgcggatcaaaaaaccaagatccatcctggtcactggtctggggcacaaaataattcatcccaaaaggcacgcctgtgtatggcagggtatttccccgagagaaggcatgcttgctagcagtaccaaagcgggtatcgatggtttcaagtagtggtttcatagtctttcctttag

SEQ ID NO: 119 - DNA, 864 bp; single-stranded, linear
ctccatctgcaatcggcatcagacaagatctccaagtgttgtttcacgtaatcaatacgaccatcatcgtaaacagtgttattaacgaactcatctttatagccgagaccattttcagtgatataaattttcttgtagttaggataatctttcttcacacgcatgatttggtcatacaaaccttgagggtagataatccaatcccaatccgtgcgtggatacatagtcagggagctacaagacgaccaatacctttgatttgatacttagagcttcctttttcacctttaccattatggataatttcagtttctccatcaaaggcttccatccagtcactcatatagtagttgattcctaggaaatcattcaagtcttttgcagcttctaatgctgtaaaatcttcttcacgaagatccaaactaccaccattgactgataagatatggttgacaccttccatggtttcagctgaatagcgacctagataagttgcgtctaagatgaatttattgtggatgatatcttccaactctgctgcacgaacatctgctggattttcaggatctagaggatatttagtaggcagggcgtgaacaacaccaatttcccctttatagcctttctctttgtacaattttaccgcgcatgcatgagacaccatcatattgtggtgtgattgaaaaactttggcaaggtcgtactggatacctggagggaatttcccaaccaaatattgaccatcaccgattggtccaatttcattaaaggttgtccaatagtttacttctggaaattcttccaaaacagaaggcagcgttagtctacaaaatgttcgatattttcaccgtttaagaagtctcc

SEQ ID NO: 120 - DNA, 1233 bp; single-stranded, linear
acgagcaatntnttcggatccatttcttctcctttgtaataagataaagtccgtttatcaaattttatttagtgttaatttggttaaaacaagcaaactaagctgctttcttggttagttgtgacaagattgccaaacgattttgacggacagcctgatcttcagccattaccatagtattttcaaagaaagcatcaatgactgggctaagcgcaaagagttgtttcaattgctgacttgcaggtcctgataaaacgagtgtttctactgcttctgccaaagctttttcttggtcattctcaaatagtgctgaatcaactgtagcaaccccttctgccttctcagccaggttaaaggcacgagaaagtgattcaacagatggtttaaaatcttcttccttgcttacttctacgagagcacttgctgcttccaacatatctgccacaacaaagtttgaacctgcaagaactgcttccttgatatcttttggagtagagcccatcatcttatcaacacgagccttgataaagtccataacctctgctttattttcataagtcaaactgtcaaatttcaatgcataaaggctatcaatcagctccaactgtataacagagtccgccagttaccatgagaatccagaaaacgggtgtngtttgactgataatggcaggaatgatagccagaaccaaccagcccataatcaggtaaagagcaaggctaaatttctcattgacctttttagcaaagattttatagagaataccaaagatggtcgttccccattggatgacaataatcagatagccaaaccagttattcatcaaggtcaagacaacgggcgtgtatgagccggcaatggcaacgtaaatcatagaatggtcaatgattcgcaaaacatatttgtgggtcgaaccataggccatagagtgataaatggtggatgataggaacatgagaaagagactgatgacgaaaatggaaacgccgatagaggataaaaatccgtgtgcttcataactatagatggatgaaataggcagcaagataagcatgatgactgcacccacagcatgggtcacgctattagcaatctcctctccaaaactgagttgtttgctgagtttaagactagtgttcattggattacctcctcttgagtatgatcgattaagtctagagtttgatgatagagtttaacggtttggcagctggtttggataatagggttag

SEQ ID NO: 121 - DNA, 888 bp; single-stranded, linear
tactattaaccttcctgtgactaaagatctccacctaaaccgttcgcgctcagctcaatcttcgtatcaaatccagtacaaacaaggggctcttatctgcccaactgctagaatttgggcaaaagaaatacctacaaccttatccagctattttaagtgctagaaccattgataacggtcgctatcacatgttggaaaatctctgtgaattgccatttagaccagaggcacaacgagtcgtgacaaaaggttaccttaatttacaaaatagaaatgatttactgttagtagaggatattactgcagatgaatggatggacgttcaatttgaactgcagccaactatttacaagctaaaagaaggagacactctccgtttagtcctctatactactgactttgaaatcaccatccgtgacaatacagactaccacttgactgtcgacctcgctcagtccatgcttaccttaccttgctaaaaggagttacattattatgaataaatcagaacaccgccaccaacttatacgcgctcttatcacaaaaaacaagattcatacacaggctgagttgcaagcccttcttgctgagaacgacattcaagtaacccaggcaaccctctcacgcgacatcaaaaatatgaacctatcaaaagtccgcgaagaagatagcgcttattatgttcttaacaatggttccatctcaaaatgggaaaaacgtctcgaactctacatggaagacgcccttgtctggatgcgcccagttcaacaccaagtcctactaaaaacccttcctggactggctcaatcctttggttctatcattgatgactttgagcttccctgacgctatcgctaccctttgtggtaatgatgtctgtcttatcat

SEQ ID NO: 122 - DNA, 1524 bp; single-stranded, linear
ctgtgattgtctttttggtctatctgatcattactgtacaaaagcttggtcgtgtcatcgatgaaacagaaaagacgattaaaaccttgacttcagatgtggatgtgaccttgcatcacaccaatgagttgttggctaaggtcaatgtcttggcagatgatatcaatgtcaaggtggctacgattgatccactcttcagtgctgttgcagatttatctctatctgtttcagacctcaatgaccatgcgcgtgtcttgagcaagaaagcttcatcagctggttcaaaaacactcaagactggtgcaagtctgtcagctcttcgtcttgcaagtaaatttttcaaaaaataaaaaaggagaatccttatgggtaaattatcctcaatccttttaggaaccgtttcaggtgcagctcttgccttgtttttaacaagtgataagggcaaacaagtttgcagtcaggctcaagattttttagatgatttgagagaagatccggagtatgccaaggagcaagtctgtgaaaaacagacagaagttaaggagcaggctacagattttgttctgaataacaaaagaacaggttgagtcaggtgaaatcactgtggacagtatacttgctcaaggctaaatcctatgcttttcaagcgacagaagcatcaaaaaatcaattaaataatctcaaggaacaatggcaagaaaaagctgcaggaattcgatctcttgatgactcagaagagattgtgattgatataacagaagaataaaccatcaccatctccggacggactaagtatctggggatggtgatttttatcacgaatctagtctttgtggcataataattactatgcagaaaaaaccaacgtcagcctatgtgcacatcccatttagtacccagatctgataacattgtgatttttcaaaggtcttcatcaaaaatcagccagtcgacagctatttagagcatctgctggaagagtttcgttcttatgatattgaaaagttgtcaaccctttatatcggtggtggaacaccgacagccctgtcggctccgcaactggaggtgttactgaatggcttgactaaaaacttggatttgtctgtcttggaagagttgaccattgaagccaatccaggcgatttggatgcggataagatagctgttttgaaaaattcggctgtcaatcgtgtttcgctaggtgtccagacctttgatgataagatgttgaaaaagattgggcgcagtcatttggagaaggatatttatgaaaatatcgatcgcctgaaactggctggttttgacaacatctccattgatttgatttatgctctgcctggtcagaccatggagcaagtaaaggaaaatgtggctaaagccattggattggatattccccacatgagtttgtatagtttgattttagaaaaccatacggtctttatgaaccggatgcgacgtgggaaattgcctctgcctaaggaggaactagaagcggagatgtttgagtacatcattgcagag

SEQ ID NO: 123 - DNA, 654 bp; single-stranded, linear
ctaagtgacgaccaagcgtagcctcgctaatcaccaattcttgagccagctgatgggctaaaaactgttggtggtagagaagataaaccaaaatctggtatttaacagcactatccaaaaaacaagctccgaatatctctccccttagtagctgcacctatagacagacgcagattttcatcttctgagtgaatagtcagttctaagccactatccaaagccttgtcattgagcagggtgacatatttggttagggttgcttttgaaaatcctgtttcttccattacagccttgacggtcgtctgagactcttgtaatagaaaggaaaggattgaaaattgaccacactcggctttctccatcaaatctcctaaatacatttgttatccctttcattttctaccttaagcatagcataaatctgacaaatgctaaaataatctgtttctctttttattttcatgctgatttcctggtccattatcctgaaaatcagtaaacacacggctccccctttgggcatttttatgctaaaatagtagctatggataaaattattaaaactatatcagaaagcggagcctttcgtgcttttgtccttgatagcacggaaaccgtccgcactgctcaagaaaaacatcaaacccaagctag

SEQ ID NO: 124 - DNA, 1181 bp; single-stranded, linear
cttgaacatattcatcaaaagaactatgaacaaagattacatccgggaagagttcatttgcaacacggaatggcttcgctcagatttttcttgggacaggctggtggtcacagccgtttcatcatcaaccattggttggtcgaagcgtaggcaacgcacatctgacaatttttgtttccagaaggtcaaggcctcatctttgtcaactggaatttcattcccgttactgtaccagttggcaaagagaatacctaaaacacgactaccatccacaccctgccagtacatttctgaaaactgagacgtaaactgctcatcttcaaggacttggttgtcaaatccaatcggcttcacaccacgaccaaaggccgccacgtgaatgcctgatttttgaagaatttgaggcgcttgtcccatatttccaaaggtatctggaaagtagccaatctgggttgatttaccccatttggcagcttcttgttgaccaatcaaggtattgcggacattggcttcactggagatcaaataatcatcctgcaagatgtaaaagggaccaattttaagcttgccctcgtcaatgtagcgttggaccttgtcgcgattttcagggcgaatttgtaagtagtcgtcaaggacaatagtttgtccatccaagtggaaactcttgaactcagggtcattttcaaagagatcaaagagattgtcaaacaattccaccaattgcatacgatggctttcaaaaggcaagtaccactcacgatcccagtggctatgtgagataatatgtacaacaacattttccatgaagtaaaacctcattctaaatttaaattttaacgttttaaatgtaaacttgtgattctgataagaatcggttgagctaaagcgagccccttagcgaatatccaagtaatccaagaccaactcacagaacatcatgttagcccaggagaaccattcacgagagtagagggtcggatcatctacatggaagctttcgtgcatgacacctgtaccaccatcgcaggcaaccagctgatccagcaagaattttttctctgccttatctcttgttgtcaatccctggataaaaaggcgaatgggccagatatagcgatagaagtatgagaacttccgagaccgctagcgtatctccttggtagaagtatggattttcagaa

SEQ ID NO: 125 - DNA, 830 bp; single-stranded, linear
ctctgacggcgtcgccacttaagaagagtatcaaaaagaaaaatagaaaattaactaacaaggnagaaaaacacatgtctaaaattatcggtattgacttaggtacaacaaactcagcagttgcagttcttgaaggaactgaaagcaaaatcatcgcaaacccagaaggaaaccgcacaactccatctgtagtctcattcaaaaacggagaaattatcgttggtgatgctgcaaaacgtcaagcagtcacaaacccagatacagttatctctatcaaatctaagatgggaacttctgaaaaagtttctgcaaatggaaaagaatacactcccacaagaaatctcagctatgatccttcaatacttgaaaggctacgctgaagactaccttggtgagaaagtaaccaaagctgttatcacagttccggcttacttcaacgacgctcaacgtcaagcaacaaaagacgctggtaaaattgctggtcttgaagtanaacgtattgttaacgaaccaactgcagcagctcttgcttatggtttggacaagactgacaaagaagaaaaaatcttggtatttgaccttggtggtggtacattcgacgtctctatccttgaattgggtgacggtgtcttcgacgtattgtcaactgcaggggacaacaaacttggtggtgacgactttgaccaaaaaatcattgaccacttggtagcagaattcaagaaagaaaacggtatcgacttgtctactgacaagatggcaatgcaacgtttgaaagatgcggctgaaaaagcgaagaaagacctttctggtgtaacttcaacacaaatcag

SEQ ID NO: 126 - DNA, 1153 bp; single-stranded, linear
ctgggaaaggagatatgtgacaataataaactgtattcgttgatagaatttagaaataaaatatatgagaattagaactttccagaagtgatttagcgattttactatgtgccangcttatcgcctctatcggattaaatatggattcgactcccgtgattatnggagccatgttaatctctcctttgatgacacctattctgggagtggggctctctctagctatatttgattttaaattgttaagaaaatcttttaaaatattagctattcaaattcttgccagtttaatagcttcaacactttatttttatctttctcccatttcgtatgctagttcggaaattgttgctagaacctctccgactatttgggatgttctcattgcttttgtaggagggatagcaggtattattggtgctaggaaaaaagagaccaataatattgttcctggtgttgctattgcaaccgccttgatgcctcctctttgtacagtaggttatgctattgcttctgctaatctaaaatttatcataggctcctcttacctattcctcatcaattgtagctttattgtcattgcgacttatataggtgttaggttgatgatggttaagaaacattattttaaagataatgaagaagactctaaaatgcgtaggattttgcttctagttgctgttttgctgatgattccgagtttcatctctgcaacgactttagtgagagaaacgttgaaaaaagagtcccttaagaaatttatatcagagcagtttcaggggcataatattttgaaaaaaacctattctaaaaagactcataccctaaagctaaccatttcaggaaattatttgacagaagaagaactcgatatgatttcaagtaagagaggtgactatggtttaagtgatgtttctgttcaagtttcacaattgtctgattcagaacaacttagtaaggaagaactggtggagtatttcttccagtatatcaaggataaggaagcaaaagaaaaggaaaaagctaataagttttatacagagtctgaggagcaataatttcttgagaatagctggtttttctcgtgagtcttctatgtatatcaaaggaagactgaggttttaagtatgaaacttttcttctattatagtag

SEQ ID NO: 127 - DNA, 1058 bp; single-stranded, linear
ctgcaatggttagcgaggatggtgaaatagaggagccttaactattttgaggaatccaagctgacaggactggtatgtctgctctttggctctgaaggcagactataccagctggaagtttgacagatgtggcacgtgagaattattggaggcnttgacntantcagaggattctctcttgatattgggtttggcagagttggatagtgagttggaaaattaccaagcggttattcaagcctatgcccagttagataatcgctcgatttatgagcaaacgggcatttccacctatcaacgaattggctttgcctatgctcagttagggaaatttgaaacggctactgagtttttagaaaaagccctggagttagaatacgatgacttaacagcttttgagttggccagtcttgattttgatcaagaagaatatcaaaaagccaccctctactttaagcagcttgataccatttctcctgactttgaaggctatgagtatgggtacagtcaggctttacataaggaacatcaagttcaagaagccctgcgtatcgctaagcaaggattagagaaaaatccctttgaaactcgcctcttgctagctgcttcacaattttcttatgaattgcatgatgctagtggtgcagaaaattatctccttactgcaaaagaagacgctgaggatacagaagaaatcttgcttcgtttagccactatttatctggagcaggagcgttatgaggatattctagacttgcagagtgaggagccagaaaatcttttgaccaagtggatgattgctcgttcttatcaagaaatggacgatttggatactgcttatgagcattatcaagagttgacaggagatttgaaggacaatccagaatttctggaacactatatctatctcttgcgtgaattgggacattttgaagaagcaaaagtccatgctcacacttacttaaaactggttccagatgatgtgcaaatgcaagaactgtttgagagattgtaagaatgtttaaacatatagaactgtagtttatctcttttgatag

SEQ ID NO: 128 - DNA, 1211 bp; single-stranded, linear
cttgttgcttgtccaattggtgtaaatttggaaccgattgacccatctgcaaagaatgctagaggaaacacaggaaattgttgcaggtcgtgttgctagtgttgaaacattgaagcgaatagaggagttaggttttgactttgtctgtttgactggaaatcctggaacaggagttagcaatcgagaaatcattaaggctgttcaaactgctaaggaaaacttttctggtttgattattgcaggtaagatgcacggggcaggagtgaatgagcctgtggcagagctttctgtcgcagagcaattgttggaagcaggtgcggatgtgatacttgttccagcagttggaaccgttccagcctttcatgaccaagagttgcgtgaagtcgttgatctcgttcatagtaagggtggtcttgtattgagtgctattggtactagccaagaaacatctgatacagatactattaaggaaattgcacttagaaataaaatttgtggagttgatattcaacatataggtgacgcaggatatgggggactggcaacagtcgataatatttatgcattgagcaaggcaattagaggagtgagacatacagtatctcgcttggctaggtcagtaaataggtgataaaggagtaagctatggctaaagtaacaattatgttagcatgtgcagcaggtatgagtacaagtctgctagtgacaaagatgcaaaaggcagcagaagataaggggttggatgcagaaatttttgcagttccagctcctgaagcagaagaaattgtagcaacaaaagaagtaaatgtgttgcttttaggtcctcaagttcgctatttactaggggactttcaagaaaaactaaaagatagacagattcctgtggcggttattccgatgacagattatggaatgatgaatggttctaaagtcttagatttagctgaaagtttattagactaagattgaggagaatgttatggatgaaagtaatttagaatctgtaatggggctaattatgtatggtggggaagccaaaagtaatgctatggaggctattcaggcagcaaaaaaaggggatttctctaaagccaatcgaagattagctgatgcgaatgctgccttattacaggcgcataaggctcaaacagaaatgttgacaagagaggcacagggggaagaaacatcaattagcctcttgatggtacacg

SEQ ID NO: 129 - DNA, 858 bp; single-stranded, linear
cttcagccatctttagtaaagacttcctgtgttgacaattggttgggcatcatgattgccacaaagaacgacaaggagatttgaaaccatggcagcttttcgttcttcgtcaagttctaccaattccccttcattgagccgttctagtgccatttcaaccattcctacagcaccatctacaatcatcttccgtgcatcaataatggcagatgcttgttggcgttgaagcataacggcagcaatttctggagcataagcttaggtaagtgatacgtgcttcaaggatttccaagccagcatcttctacgcgactttgaatttcctcacgaatacggttagcaacaatttcgctagagccacggagactaccttcatctgcttgcccgtcacccgtagtatccacattaggagacacatcgtaaggatagatgcggacaatattacggagggcgctatcacattgcaatgaaagatattctttgtagttatcaacgttgaagactgccttagcggtatcgacaactctccaagttaccgcgataccgatttctacagggtttcctaagcaatcattgattttttgacgagaattgctcaaggtcatgactttgagggaaatgtgtttcttgccaatttcaagatttacatcattgtcatttgatgatttagctcctaaaaaaggagattttgtgctaacatcaccactttgtccaagtcgaatgtggtttgcagggttgactgctacgctgaagggattgacaaagtaaaaaccaggttctttcatggtacctgtataattaccaaagagtgtcagaaccagagcttcctgaggtttgacaacttttaaaccagcatgag

SEQ ID NO: 130 - DNA, 723 bp; single-stranded, linear
ttacttcgctaaacaatcaaaggaacagtcaaaaattcagttggagctggtgattctatggttgctggattcacaggtgaatttgtcaaatcaaaagacgcagtagaagccttcaaatggggagtggcttgcggaacggcaactaccttctcagatgacttggcaacggcggaatttattaaagaaacatatggaaaagttgaggtagaaaaacgatgaaaattcaagatttattgagaaaagatgtcatgttgctggatttgcaggcaactgaaaagactgctgtcattgaagagatgattaaaagcctaacaggccacggttatgtgacagattttgaaacctttaaagaaggcattttggcgcgtgaagctttaacttctactggtttgggtgatggaatcgctatgcctcacagcaaaaacgctgctgtcaaagaagcgacagttctctttgctaagtcaaacaagggtgttgactatgacagtttggatgggcaggcaactgacctcttcttcatgattgcagctccagaaggtgccaatgatactcacttggcagcattgacagaattgtctcaatacttgatgaaagacggttttgcagacaaacttcgtcaagcaacatctgcagaccaagttatcgaactttttgaccaagcttcagaaaaaactgaggaacttgttcaagcacctgctaatgactctggtgactttatcgtag

SEQ ID NO: 131 - DNA, 882 bp; single-stranded, linear
aatctcgttgatttagactttaaccgtgtcatctattttaggcgctggtccttttctttggacttgctcatgaagctcagctcaagattttggaattaactgctggtcaagttgcgaccatgtatgaaagcccagttggcttccgtcacggtccaaaatctcttatcaacgacaatacagttgttttggtctttggtacaacgacggactacactcgtaagtacgacttggacttggttcgtgaagttgctggtgaccagattgctcgtcgtgttgtgcttttgagtgatcaagcttttggtcttgaaaatgtcaaagaagtggcccttggttgtggcggtgtcttgaatgatatttaccgtgtcttcccttacatcgtttatgcccaactctttgccctattgacttcactcaaggtagaaaataaaccagatacaccgtctcctacaggtacagtaaaccgtgtagtacaaggtgtcataattcacgaatatcaaaagtaagacagtgtttatgaattcttgacaagaggatttgtaaattatcagataaaccatagattgtcagtacgctttctatggtttgtttgcttgagagaaatagtaaaaggagaacagaatgaaagcatacacagagcgtgtatttggaaatgttgagggtgaggatgtcttggcctatcgatttgagacagacggtggctaccaacttgaggttatgacttatggtgcgactatcttgcgctatgtcgcacctgacaaggctggaaattttgccaatgttatcttgggatttgatgactttgatagttatgtaggcaatagtcccaagcatggagcaagtgtaggtcctgtagcgggtcgtattgcaggtgcgacctttgag

SEQ ID NO: 132 - DNA, 864 bp; single-stranded, linear
ctcaagggcttgaaatcatccagataaatgaagaacaaggccaatttggttttgaccgcgttaaggaattggttgatacttacaaggtggaacgatttgtagtgggcttgcctaaaaacatgaacaatacaagtggaccgcgcgtagaagctagtcaagcctacggagcaaagctagaagagttttttggtttaccagtagactatcaggatgaacgcttgacaacagtggctgctgagcgcatgttgattgaacaagcagatatcagtcgcaataagcgcaagaaagtcattgataagttagcagcttcagctgattttacaaaattatttagatagaaaattttaatataaaggagaggctatgtcacacgatcataaccacgaccacgaagaacgtgaactaatcacactagtagatgagcaaggaaatgaaaccttgtttgaaatccttttgacaattgatggaaaagaagaatttggtaaaaactatgttcttctagtaccagttaacgcagaagaagacgaagacggacaagttgaaatccaagcttactcattcatcgaaaacgaagatggaacagaaggcgaattgcaaccaatcccagaagactcagaagacgaatggaacatgattgaagaagtcttcaacagctttatggaggagtaaaaacgtccgggggacgtttttagccctgcgctagaaattagaaacgcaggtagtctgagagactgtatcagcccaactcccagaaatggggaagagttggaacgtccagtgaacatttttaccccaactcctagaaattgagaagagttggaacatctagtggatatttttagcccacgttcacattcatagtag

SEQ ID NO: 133 - DNA, 952 bp; single-stranded, linear
gtatcgttcaattccaaagatacggaggaagctgcgtttcgcgagaaaactcttgttagaccagatagggattagccaaaatccttctatgngcttatatccaaatggagatgcaaacttctgcccaactcttgaccaataagatctttcttaaaaatccactcaaggctctggtagaggaaaaatatgggattgagtatgaagaatttaccaatccttggcacgctgccatttctagcttcgttgcctttttccttagaagtttgcctccaatgctgtcagtgaccatattcccaagtgaatatcgcatccctgctactgtccttattgtcggtgtggcccttcttctcactggttacactagtgccagacttggaaaggatccgactagaacagtatgattcggaaccttgctattggtctcttgaccatgggagttaccttcctgctcgaacaacttttcagcatttagaatacaagaaatacctcgattttgaagtcgaggtatcttttttacatttgcacaatcttgcgataacttcttgaagtaatcatgaaaatcagcacataggcgatgaggaagatagcgcagatagacaaggtcacaatcaacatcatagtcgtatccagtacaccaatcacttttaaaatcaggctaagcatatggtaggcaaaggcgagatgtatgaaggcaaagagcaaaggaaggaagaaaacagttaaaacctgtttgttgatggtttgcttgatttgcttttggtccaaaccgactttctgcaagataataaagcgttcacggtcttcgtagccttcagaaatttgtttgtagtagatgaccagaacagttccgaccataaagataatggataggaaaataccgataaagaagacaccgccaaagaggacactcatttgagcactagcatctgctagattgctaccataaacatag

SEQ ID NO: 134 - DNA, 1133 bp; single-stranded, linear
acagaattactcactattctgcgtcttctgctaaaagtttaaactcgtgtttcttcatccaaaagtgggtaacctaggcgtttgcgttctgcaacaaaggttttggctacaacacgggccaagttacggatacggagcgatatagcctgcacggctctgttacagatacggcaccacgcgcgtcaagcagattaaaggtatgtgaacatttgagaacatagtcataggcagggtgtaccaagccttcttctaatgcacgaccagcttctttttcaaacttatcaaagttttcaagcaacatttcttggttcgaaatttcaaatgaatattttgagtgctcatactcaggctggataaagatttctccgtattttacaccatcagcccactcgatatcatagacagagtctacttcttgaatgtaagaagccaagcgctccaaaccataggtaacttccgcagtcacagggccagttgccaatccaccgacttgttggaaataagtgaactgagtgatttccattccgtcaagccaaacttcccaaccaagaccagctgaaccagttgatgggttttcccagttgtcctcaacaaaacgaatatcgtgctccaaaggattgattcccaatttttccaaagactcaaggtaaagttcttggatatttgatggagaaggcttcatgaccacctggaattggtggtgttggtagagacggttagggttttccccataacgaccgtcagcaggacgacgtgatggctctacataagctgcattccatggcatcaggtccgataggcacgaaggaaagtgtaaggactcattgttcccgcacctttttcattatcataagcctgcataagcatacaaccttggtcattccaaaattgttgcaaagtcaaaataatttcttgaaatgttaattccttagacattgaatactccttaataaaaaataatttcttgcgacacgagttctgcctcgtcgattataccnaggcacanaaattantnctngcttccaaattcgaatcccgcnnccccgggggattcnnttttcntaaaccggcccccccccngngggaacccccccntttttnccnttatttaagggttantcncccncttgncn

SEQ ID NO: 135 - DNA, 806 bp; single-stranded, linear
acctaattttttcattagatcctccaatttattagggctttgccccttattttaacaaatgtttatttttcagtttcaaatatcgttgtttgggagcgataaagaagctaatgagaaagaaactagcagctgtaagcacgatactagaacctgccgcaacattaaaactatagccaataaagagtcccaaaactgaagcagtagctccgaaggttgaggaaaggaaaatcatgcttttcagactattagcatacagataagcagttgcagctggggtaatcagcatggctacaatcaggatagttccgacactttgcatggctgtcacagacacgagagtcaggagtaccatgagaaggtagtgatagaaattgacaggcattcccatggctttagccaagagttcatcaaaggaagttatcaagagttgcttgaagaaaatccagattaacaagaggatggctgcccccacacccatagtaataaacatatccgtatcttggacggccaggatattaccaaaaaggatatggaaaaggtcagttgaacttttagcgacaccaatcaagatgataccgagggctaagaaagaagaaaaggtaatgccgatggcggtatcgcttttgataatcgagtttcctttgatgtaggtaatgatgatggcagctagcaatccaaagacaatggctccgataaagaatcaaggcccaagatgaaggagagggctacacctggtaagacagcatgttgaaatggcatctcccatgaattgacatcccgcgtagaataatgaaacatcccacaga

SEQ ID NO: 136 - DNA, 1096 bp; single-stranded, linear
ctaacatttcctttgctacttctaataatgtcatagtggtcattaaatgatcttgagcatgtaccatgataatttcaattttaatttccactccacttgcgtattcttgcaagagtttggtttgtgcatgatgcgcttcaagaattatctcatttgattgatttaatttactttctgcatcatcaaaactaccttctctcattttttgcaaatgcttcatgtatttctgaccttgcatttcccgaatgcaggataatttcaaatgctgcaacctgcagttcctcttgattcatatgaacctcctattttatcttctcaaatatgttaataaaatcttcaaagttattgcaagatattagctgattttgcaattcatcattctctgtcaaagagactatctttttagtcacagttgccaaaccttccgttcccatatattgatggagatagaagaaatagctagtctggacatgtgaactttgattatcccagagtaacgaatctttacaaattgcaaccgaaaccttttcctctgtaccaaagggctgaataggatgcggaactgcaattttttcagaaaaaacaactgaacttaattcttcgcgctgtttaattccataaagtaaagattgttcaaactcatttgattcaccaacagataaactctcaaccatcttttcaagtaaatttaccttgtctgattcagtacatattaaaaagttttctttactaaaatactgtctaaagccgttgttttcaaatttgttaatctttgatgattgtacataactagaaacttgcatctgaaccatagcttttctaatcatttccatctcatcactcttaagaaacacactaactttaaaaactgggatttgaaaatatagatttgataaatcaacagctgacactataaaatctattcctttaagtttttcttgattcaattcataatagcctattacatcaacaacttctactcgcttcccaaactccgtttccaaacgatttcttaacatttgggctgcaccaaatcctgttgcacaaatagcaagaatattaaacttagtactctctttgctacgttccatagcag

SEQ ID NO: 137 - DNA, 1124 bp; single-stranded, linear
ggggattttggttgctggggtaacacgtggagatgttcaaatgtgaaaatatcacagatacttcaagcgtgttaaggacatccctttgactttgccagaagaactagatatcacagttcgtggggaatgttacatgccacgcgcttcctttgaccaagttaaccaagtgcgccaagaaaatggagagcctgaatttgctaatcctcgtaatgcggcagcaggaactattgtgtcagttggatacagcagtagtttccaagcgtaatcttgcaacgtttctttatcaagaagccagcccttcaactcgtgatagccaagaaaagggtttgaagtacctagaacaactaggtattgtggtcaatcataagcgaatctttggctggaaaatagataaaatatggaattttatccaagaagtaggacaggaacgggaaaatttgccttaagatattgatggagtggtaatcaaggtcaacgacctagcaagtcaagaagaacttggttttaccgttaaggctccaaagtgggcagtagcctacaagttccctgctgaagaaaaagaagctcaactcttatcagttgactggacagttggccgtaccggtgttgtaactccaactgctaatctaacaccagtacaacttgccggtacgactgttagccgtgcgaccctgcacaatgtagattatattgctgaaaaagatatccgaaaagacgatacggtcattgtatataaggctggtgacatcatccctgccgttttacgtgtggtagagtccaaacgggtttctgaagaaaaactagatatccctacaaactgtccaagttgtaactctgacttgttgcactttgaagatgaagtggccctacgttgtatcaatccgcgttgccctgctcaaatcatggaaggcttgattcactttgcttctcgtgatgctatgaatattacaggccttggtccatctattgttgagaagctttttgctgctaatttagtcaaggatgtggcggatatttatccgtttgcaagaagaagatttcctccttttagagggggttaaggaaaatccgctgctaaactgtatcaggctatccaagcatcaaagaaattcctgccgagaaga

SEQ ID NO: 138 - DNA, 1264 bp; single-stranded, linear
cttggtagaacttgctaatcaagctggcaagcctgtagtcttggactgctcaggtgcagcactttcaggctgttcttgaatcaccccataaaccaacagtcatcaaaccaaataatgaagaattgtctcagccttcttggaagagaagtttctgaggatttggatgaattaaaagaagtacttcaagaaacctttgtttgcagggattgaatggattatcgtttcacttggtgccaacggtacttttgccaaacatggtgacactttctacaaggtagatattcctagaattcaggtggtaaatcctgttggatctggagactctactgtggcaggaatttcttcaggacttcttcacaaagaatcggatgcagaattactcatcaaggcaaatgtccttggtatgctcaatgctcaagaaaaaatgactggtcatgtcaacatggccaactatcaagttctatatgatcaattaatagtaaaagaggtataaaatggctttaacagaacaaaaacgagcacgcttagaaaaactttctgatgaaaatggtatcatctcagctcttgcatttgaccaacgtggtgctttgaaacgcctcatggctcaacaccaaacagaagaaccaactgtggctcaaatggaagaactgaaagtcttggtagcagatgaattgactaaatacgcttcatcaatgcttcttgaccctgagtatggacttccagcaactaaagctcttgatgaaaaagctggtcttctccttgcttatgaaaaaacaggttatgacacaacaagtacaaaacgcttgccagactgcttggatgtttggtctgcaaaacgtattaaagaagagggtgcagatgcagttaaattcttgctttactatgatgtagatagttcagacgaactcaaccaagaaaaacaagcttatatcggagcgtaccggttctgagtgtgtgggctgaagatatcccattcttccttgaaatccttgcttacgatgaaaaaattgcacacgcaggttctgtacaatatgcgaaagtaaaaccacacaaagtgatcggtgctatgaaagtcttttcacacccacgcttttaacattgatgtcttggaaagtttgaaagttcctgttaacattaaatatgttgaaggctcccctgaaaggtgaagtgggtttacacacgttgaagaaaccagcagccttcttcaaagcgcaagatgaagcaacgaacttgccatacatttacttgagtgctggtgtatcag

SEQ ID NO: 139 - DNA, 597 bp; single-stranded, linear
ctgaactggattttgctacaaggtctgatttgtcaaagagatgcgagttatgatatgaagcaggatgatttggataaggtagcagattatctcttcaaaacagaagaatggaccatgtatgagttgattcttttcggtaacctctatagtttctacgatgtagactatgtcactcggattggtagagaagttatggagagggaggaattttaccaagagattagtcgccataagagattagtgttgattttggccctcaattgttaccagcattgtttagagcattcttctttttataatgccaactattttgaggcttatacagagaagattattgacaaaggtattaagctttatgagcgtaatgttttccattatttaaaaggttttgccttatatcaaaaaggacagtgtaaagaaggctgtaagcagatgcaagagaccatgcatatttttgatgtgttaggtcttccagagcaagtagcctattatcaggaacactacgaaaaatttgtcaaaagttaattttcccaaataagggaaaaaataaaaagctcctttcggttttgatacaatagtttcaaaatttgagaggag

SEQ ID NO: 140 - DNA, 623 bp; single-stranded, linear
cgtgttcccagatggccgcatccatttattgagccagacgtgtccaaactcatcagggttatcttcgataaccaaacgaatacgagtgcttcgtcgccaccaaggtctggtagttgacgatgttcaaaagagccgtttcgaccaactgacattgggctagaggtccttccacctgcacaatcggttcattagcaaaaaccaaatccccttcttgggcagaacgaacggtcaactccaacttgaaattgcgaaggtaatccaagaacgccccatgataaccaagcgactccaaataggctatatcactatctgaaaaacgcaagtcttcaagatagttcacaattctttccaaacctgcaaaaaccgcatagccgttcttaaaaggctgttggcggaaatacacctcaaagaccgccttcttattgtaaatcccttgatcaaagtaaacctgcatcatgttgatctggtacaagtccgtgtgcaatgtcaaactatcatctggatacatacttttcctacttccttagctagaaacccatgaaaattttcaagaactttcatgtattccaataaattagtactattatatcacattttagctggattgagaaaagagtaacaag

SEQ ID NO: 141 - DNA, 609 bp; single-stranded, linear
ccatgttggttctcaactatgtttatgctgttcctttgtacgctaagtttgctaactttgatattggaaaaattttgggactttccaactacctaatgaccatggtattaccttttaacttgattgaaggtgttatcttttccgtttcattctggttgttgtatgttctcttgaaaccaaccttaaaacattatgagagataaacaaacatttttaatgaagggcagttttgcccttttacttttcgttattcttggctacatggtcaaattttaccctgaaacgctggtcaattttgaccaatcgattcagactgccattcgaggagacttaccagattatttgactattctttttcgagccctcacacgtctgattgatatcccagtgattatcacttgggttgtcattacagcttttgtcttttatcgtaagcgatggaagatagaaagtttcttcatgctgggaaatctggctttggcaggtcttttaatcgtgacctttaaaaatatctaccagcgcccacggccagatatcttacatctggtggaagagaagggattttccttcccaagtgggcattctctggctgtaaccttgatggtaggt

SEQ ID NO: 142 - DNA, 638 bp; single-stranded, linear
ctaaaaaagttacaagtgttgccatgccgagttacattggttccagcttggagtttactaagaacaatttgattcaaattgttgggattaagggaagctaatatagaagttgtagaagtgacgacagcgcctgcaggtagtgtagaaggcatggttgttgaacaaagtcctagagcaggtgaaaaggtagacctaaataagactagagtcaagatttcaatctacaaacctaaaacaacttcagctactccttaaaagcagatggataatcaaaatgagtaatcaatctttgtcatgatttcatggcaaagattttttttgagtccagatttgtgatagaatagagggagttgataaaaggaggaaagcatggaagaatcaaaagaattaaatgccgtcattgatgtgattatgctagcggggactattctccttaaaagtggctcagaaatccatcgtgtagaagataccatgattcgaatcgcgcattcgcaggggattgtggattgcaatgtccttgccatgcctgccgctatctttttctctattgaaaataccaatatttcgcgcatgaacgcgtgacctcctcttcttataacatcgaaaaagtctgcgatgtgaaccagatttctcgtcag

SEQ ID NO: 143 - DNA, 1450 bp; single-stranded, linear
ctccatatttcttagccttctcaattagggtcttgaagtcttcgacaccaccgatacgcttaccaatatcagcatagttcaagtgaccagagtcatggctgtgatatccttaactttttcccaaccttgagggttgttcataatgctacgataagcaatggcaccatcttgccaatcaactttcttgtctgcattggcatcttcagtgataacaaccttagcacttggaagttccttcgtgtattctgggaaaacaatgcccttataagctttttcccattgccattcagagctgtggattcctacatagttggcatttccgactgtttctttataagctgtcaaacgagtccagtcattcgaaccaccaccatagctattttgagagttactccaaacaccagcagcaagcttatctgtagaaacaaatccatacatgtaacccttagccaaatccttcattggattggttacatcgatatgatcatctccgctgacatgcgtattgtttgacatggttgccccatcaaacttagcaccagtttgatcactagaaacagagactaaagcattgccgaggaaactaatagaagaaagtagttttctttcgtcatcaatcttttgacctggagtgacttgattgtggttgacaatcttggtcacatcaaagtgcaattgattgtccacaacttgcaagcgtactgtcatttccgcattgattaagtgagcatcatcgcgaagcttcatcaagtactctgctgttgtctcattgatttttttataagtgacttcaggggtgattcggtggttattgataaagacttggttgaattgttgcacctgtcctggcaaagtatgtccattcaaggtgtatcccttgacacgaaggaaggcttggtcaattactgccttaagtaccttaaactggatcgtatcataagtcaccttgctatcgtcaacaaccggacctgtttctttctgggcaggggtatcctctgggttttaccctctctgtggctatccgtttcaacgcttgaacaactggtcgctcatcgtcataagagcccgccttgagaaaaatcttcttctcatttctaagatggtcattgaccgcagctggtagagtcactgtgtcaaagaagattgacatccttatttgcctggcatttacctgaccgtctgacttgaagactgatagagagacggtttgttgatcctgtttcaggagcagcaacacgactacctctataccaagtgctagttgttggagatttatactcccagaaccagccatccttgtcataaccgacaaaaacattattattggtatctttaaatttcaaggagacaccaaagcgtgatttgcccttttcagaatcttctttgaaggttaaatcaacagttgcatttccattggcatcaacggtcaagcccttcttttcaaacagag

SEQ ID NO: 144 - DNA, 1474 bp; single-stranded, linear
ctgtattgcgccatgaaggcaatcaaaagtggtatgccgtcttgntgaaaatctcttggaataagctggaaaagggcagagaaggacaagtggaagcagtcaacctcaagcatgaccaagtagctaatttgctttcacaaaaggggatttatccagccttccatatgagcaagcgctactggattagtgtgtcccttgatgatactttatcagatgaanaagtactggaattgatagaaaaaagttggaacttaacctctaaaaaatgaaatattttaataattttcatgaactttcaattagctaaatattctttactgaagaaattttcagaaaatataggatttaccacaccagaggaatgtggtgccatcttcaaatacctgattgagaatgtcaagacggatcgtcagatcatctattcgcctcactgtcatgatgaactccgaatggcagtggcaaatagccttgctgctgtcaagaatggtgcaggacgtgttgaagagactatcaatggtattagggagcgagctgaaaatgctgctttggaagaaattgcagtggctctcaatattcgccaagattactaccaagtagaaaccagtattgtcctaaatgagaccatcaatacgtcagaaatggtttctcgcttctctggtattccagttcctaaaaacaaagccgtcgttggtggcaataccttctcccacgaatctggtattcaccaagatggagtccttaaaaatcctctcacttatgagatcatcacacctgaattggttggtgttaagattccgcttggaaaattatctggtcgccatgcttttgttgagaaactgagagaattggccctagattttacagaagaggatatcaaaccactctttgctaagttcaaggcactggccgataagaagtaagaaatcacagatgcagatactcgagctttggtagctggaaccatggttgaaaatccagaaggcttccactttgatgatttacaacttcaaactcatgcagataatgacattgaagcgctcgttagcctagccaatatggatggtgagaaagtcgaatttaatgcgacagggcaaggttccgttgaagcaatctttaacgctatcgataagttctttaaccaatctgttcgtttggtgtcctacactatcaatgcggtaacagatggaatcgatgcccaggatcgggttttggtcactgttgaaaacagagatacagaaaccatctttaatgcagcagggcttgattttgatgtgttgaaggcttctgctattgcctatataaacgctaatacctttgttcaaaaagagaatgcaggtgagatgggacgcagtgtttcttaccacgatatgcctagtgtgtaaaggagaaggctatggcaaagaaaatagtagctcctaattacgagaccgaattggcccacaaatcatggaggctggtttagaagttctggaag

SEQ ID NO: 145 - DNA, 1455 bp; single-stranded, linear
ccatacgacctgtttctttcggtagagcaactcccagttgaccagtcaagccgaccgctttggcaatgtantccatattttgttggatttgcatgancaaatattgcaatggatacaagttatcactcttgatgtaaagaagggcgttgaaccagtcattccagaaaccaagagctgtcaaaagcgtgatggttgcgatacctggtagtgacaatggcaaacagatttggaagaaaatccgagcctcactggcaccatcgatacgagccgattcgagaatggcttctggaatggtcttcttgaaaaaagaacgcatcaagatgatattgaatggtgagagaagcattggaacaatcgaaggcccaaacagtgtcaccaagctgaagtacacgggtcaccatgatataacctggtaccaaaccagcgttgaacaacatactgagaaggacgaagatggtaaaaaatctgcgatacttaaaggttgtccgtgaaatagcgtaggcataggttgttgtgataaagacatttgtcaatgtcccaactacggttacaaagacagagatgaagagggcttgtaggattttatccttaaactgtgccaaaaactcaaaaccgtctaagccaaattgggatgggaagaagctatagccgtattggaggaggcttttctcgtctgtcactgaaataatgataacgaatacaaaaggtaggatacaagagagggcaatcaaacccgaaatgatactgaagaagatatctgctttcttactgaaggagtgaatgccgacattatcaattttttcttttttaattttcttttttgccatattctcctcctttctagaacaaagctgagtttggatcgactcgtcttgcaagcaagtttgataggataaccagaatcaaaccaacaacggattggtaaagaccggctgctgcagccataccgatatctgctgtctgagtcaaaccattaaagacatatacgtccaaaacgttggttacattgtaaagctgaccagcattgtgtgggatttgatagaagagaccgaagtctgcgcggaagatatttccgactgcaaggatggtcaatacagttacaagcggagtcaactgaggaatggttacgttgcgaatacgttgccacttgctagctccgtccactgtcgctgcttcgtagtaggttggatcaattcccatgatcgtcgcatagtacatgacactgctatatccaaagcctttccaaatacctaggaaaagtaggagatagggccagatgcccaggtcagcgtagaaattgacttctttgagaccaagactttccaatagatgattgaacacccctttatcaatatttaggaaggcatctgtaaagaaactaatgataacccaagacaagaagtaagggaacaacatagaagtttgaaaaatcttcaccattctcttagaacggag

SEQ ID NO: 146 - DNA, 769 bp; single-stranded, linear
ctaaaaagaccaacttggccttgccgtcttgaatggccttgaccaccaattcttcacccgatatgatgcgccctgctcgctgagcaagccccaagagattacttatcttttgcttattcaagtcccaactctcttcttttcactttgtgatccacataagcgatcaactcgtcataaaagctttcttccacttccatgctaaagctgcggttaaagaccttcttctttttcgcctctagggcttctgcattgtctagtttgatataagcgccgcggccattggccttgcccgtaggatcaataaagacttgtccttccttgttcttgacaatgcggagcaaatcacgcttatcaatcacttcgttagacacaacagacttgcgcaaagggatttttcttgttttcatctttccctcctctagcagcttttattcttctacagtatcgttttctacttccaactctactgaagcagcgtcttccatggcttcaaattcgctatagcagacttgatatcgatacggtaaccagtcaagtgagccgccaagcgcacgttttgtccacgacgaccaatggcaagagaaagcttgttatctggaacaaccaccaaggcacgtttgctgtcgttttcatcaaagataacttggtcaaccccagccaggagcgatgggcatggtagcataaattcagctggatctgccacccacctccaaaacatcgatattttcttcgattggtaccatgcggtcatttttagcatcgtaacgag

SEQ ID NO: 147 - DNA, 834 bp; single-stranded, linear
ttcgcaaggacaaggacttcaccggaggacaatttttggagagaccagcagctggtaattcgaacaccttctacctcgaatccctgtagttgacattttttcagccaactcttgtgatggcacatcaatgtccaccaattcttttaaccatttataagatacaagcataatttagttctccagaatgacagttgtcactctagttcttttcctttcctatcatttcaatagaagaatcctcttcttaccttaatttctttctcagtaaccaatccgtatctactttttgaccaaccataaaatgatgttggctaaatttttcaaaaccatatcggttataaaacgcttgagcttttgtattatgctcccaaacacctagccaagcccaagaaaaactattttttgtagcaagttcaagagcaaattcaaacagttgcttacctagtccaaatccttggaatttttgtagcacatagaggcgttgaatttcaaaagcgtcctctaattctctctcagtttgagcacttccccagttgactttgagaaaagcagctatctcctcctcctgcataatgaaataggtttcagagtcaggatttcccaactcagttgacaaagttttcagactataagcctcttcaaagtattcctgtaactgctcttccgtattatcatacgcaaaggtttcacgaaaggtttgtttggcaattttagccaacacctcaacatctgccatttctacttttctaatcattatttaaactgttctgagaagcggacatctccttggtagaatccacggatatcgttgattccataacggagcatagatcg

SEQ ID NO: 148 - DNA, 856 bp; single-stranded, linear
ctcgtaaatggaatgtggtcagtaattttggtaaatttgcagatcctatggcggataagttactagttatgtcggcttttattatgttgattgagttaggtatggctccggcttggattgttgcagtgattatctgtcgtgagttagctgtgacaggtttaaggcttttattggttgaaactggtggaacaattttagcagcagcaatgcctggaaaaattaaaacttttagtcagatgtttgccattattttcttgctattacattggactttgcttggtcaagttctactttatgtagccttatttttcactatctactctggctatgactatttcaagggtagtgcctatgtatttaaagggacatttggttcgaaatgaaatcaataattgatgtaaaaaatctttcttttcgctataaagaaaatcagaactactacgatgtgaaggatattacgtttcacgtgaaacgtggagaatggctttcgattgtagggcataatggtagtggtaaatcaacgacggttcgattaattgatggcttactggaagcagaatccggagagattgtaattgatggccaacgtttgactgaggaaaatgtttggaatatacgtcgtcaaatcggtatggtttttcaaaatccagacaatcaatttgttggagcgactgttgaagatgatgttgcttttggtttggaaaatcagggactttctcgtcaagaaatgaaaaagagagtggaagaagctctggctttagttggcatgttggactttaaaaagagagaaccagcgcgtcctatcaggtgccaaaagcacgtgtggccattgcaggtgttgtagccctaagaccag

SEQ ID NO: 149 - DNA, 1037 bp; single-stranded, linear
tccccatcccagtgggcagcagcattagtctgtacttctgcgtcgttgcgttttattagaagactgattttgctttgaactacttgaagctgtcgttgtatcctgcgaagtttttgctaacttcagtttcatttgcagcgacatgactagttgccaagcctagtaaacagatacttgctaatccaatttttgttttcaatctttcctctcctataaaaaatgtaacagacatctgaatgctgttccacctagcttttgctacttactgattattttacaaagtcaagcaaagccaagaagctttcagcttcaagtgacgcaccacctacaagggcaccgtcaacgtctgggcaagccatgtatgaagcaacattttcaggtttaacagaaccaccgtattgaacacgaactttgtctgcgacttcttgaccaaagtcagcagctacaacgtcacgaacaactttacacattttttgtgcatcgtcttgtgaagctgatttaccagtaccgatagcccagattggctcataagcgataactgaggcagcaacttgttcagcagtcaatccagccaatgcagcagatacttgagcacctacgaattcagcagctttaccagcttcgtaagtttcaagtgattcaccacaacagatgattggaagcataccgttcgcaaagattgcttttgcttttttgttgacatcttcgtcagtatcatggaagtagtcacggcgttctgagtgaccgataacaacgtagtcagtaccgatttctttcaaaacttgtgggctagtttcaccagtgaaagcgacctgcattttcaaagtagcagtattgagcagcaacgttaaagtttgagccttnggcaacagcaagnacagttgtcaaatcaagagctggagcagngatacctgcttcaacaagatctgatgaaggaagttttgatgcaactgcttcaacgaatgntccagcttnttggggatttttgttcattttccagttaccagcgataaatggtttacgtgacatttcacata

SEQ ID NO: 150 - DNA, 998 bp; single-stranded, linear
gattctacaggatccattttactatcttacgcgccgggaagtaggctgagacataaccaagtaatagagccaacaactagagttcctaaaacagataaaagatttaattcaaaaaccttagtgatggatgggtaaaagtgacttacaatcgcattcgccaaacttcccaccccttgtgcaaccaaaaatgccagcagcaaggcgatgcctacaatccagatagcctcgtaaataaaaattcctttgacatcacgattctgataaccaactgctttcatgacacctatttccttggaacgttgcatgatattgatgtaaataatgataccaatcataaccgctgctaccacaatagcttgtgatgaaagcacaatcaataatccctgaataacacgaataaaggtaatcacaatatcaagaactctctgttaagaaagcacagtatacttcttatttttctgtaattcttctgttactacttttgtctgtgatggatctttgagttccaagataaaataagatacagctttcgtaaatccagcctctttcaaaatcgtttccatttgatgagacagcatgaaactgttgctgtcctccatgtcatcttcatcattgattacacgtacaatcttcgtttgaaattgagcaatcttactagtttcggcagcactttctacaatgctgactgagactgatttgccaataagatcattagctgtcaaattttttcctgtctgttcattccaattttttagtaaactgcttggaatcgttaatccctgttcatttgtatcagtatagagggatccagccaacactttgtccgtctcattattactaacagagatacttgtatcatcataaagactcactacttgagcataagaagcatcgtttgactcaaatccatttcttgcccatcttttcttgcccatctatagtaatatttgacatgttcatcccaaaaggactctccaaatatttaatagatcgagcct

SEQ ID NO: 151 - DNA, 1261 bp; single-stranded, linear
cacatgtcgactaagccgttagaaatcaagtgtataggcagttcatcatctaatagagcgttgcgtccgaaagtctatccagacacggctctttaaaaacaaaaggagaaatgatgcatacttatttgcaaaagaaaattgaaaatatcaaaacaaccctaggtgaaatgtcaggtggttaccgtcgtatggttgcggctatggctgatttaggattttcaggaactatgaaggctatctgggatgacctctttgcccatcgtagttttgcccagtggatttatttgctggtttcaggaagtttccctctctggctggagttggtttacgaacatcgtattgttgactggattgggatgatttgtagcttgacagggattatctgtgtaatctttgtatcggaaggtcgagcaagtaattatctttttggcttgattaactctgttatttaccttattttggccctacagaaaggcttttatggtgaggtgctgacgacactttacttcacagtcatgcagccaattggactctagtttggatttatcaggcacagtttaagaaaggaaaagcaggagtttgtcgcgcgtaaactggacggcaagggctggacaaagtatctttccattagtgtgctttggtggttggcctttggcttcatttatcaagtctattggtgccaatcgttcccttatccgtgattcaatcaccagatgcaaccaatggggtagggcaaatccctcatgacaagtctgtttaccgtgaacagtggatattctgggcggctaccaatgtcttttcaatctatctctggtggggagaaagcctgcaaattcaagggaaatatctaatttatctcattaacagtctagttggttggtatcaatggagcaaggcagctaagcaaaatactgatttacttaactaggaaaagatgtttgaaagtgctgttttgagatttcgattaaaacagatatagttgataatcaaggatttatagtatgaaaaagaggatcggcgggtcctcttttgttgttgaaaagataaaaaactcagtaacctagaaataagacaactgaagctttactctatattcaatttttaggaatgagaaggtctagataaaattggacaacttcctggtctgtgaaatcttgaccttttttgagccaccaggtcaatgtctcgataaagttggacacgaccaagtgttggaggtaagaagtaggcagattagggtgggcttcttttaaattatcag

SEQ ID NO: 152 - DNA, 442 bp; single-stranded, linear
ctgatcatctaacacagaagggaacgtctcatctattctttgatctggtggtaggtaactgtttctttgctttaggatgtggttagggaggtgaagtcagataagtagatgggcttaatttgcccaagtcccacatcaaagaattatcggcgaatccaaggtgctcctttaattatttgtagatcttcaggagcaagggagacaacttgcacgtgtccaacgtaacctgaaaggcgtgcctgttttaagtgattaacttttgtcacgatgcctttttgtgttagttcgatttctaggggaatggatccagtttttttctgaacgagacctgaaccatgaaacttgtgcctcatcatcaatgaatgagattctttatctgttcgagttcgatcgactacagcgtcaaggctaacaaatagatagcctctatcatgtctgtttt

SEQ ID NO: 153 - DNA, 1282 bp; single-stranded, linear
gagctgatgaacgctccaaagaatttcgcaaatcatcaaaacggtacttaatccccccaaccaaatcggcatgacctgggcgaggatgagtaattttccgcttgcttttaaggcggtcttcaatgtcctccgcagacatgatgtccagccatttctggtggtccttattgatgacatacatagtaataggcgcccctgtcgtcttcccgtggcgaacgcccgaagtaaagacaacctggtcattctcaatcttcatacgaccaccacgaccgtagccaccctgacggcgtctaaggtcctcattgatatcctcagctgtcaatggaagtccagctggaattccctcaataatagctgttagacggggaccgtgtgattctcctgcagttaaatatctcatacactctccttattttaccaagtagtctttcatctcttccagagaaactggatgaatggtcgctgaaccaagctctggcaccaagaccaatttcaaggtgttgccacgcgctttcttgtcatgagtaagagcctgataaagcttgtcaacttcccaattttcatagtcaacaggcaagccgaatttctgacacatctctgtgatagattgggtaatgccagctggcatgaggcctttttcctcagcaatcttggaaatctgtaccattcccatggcaacagcctctccatgcatgaccttgccataaccggcagtcgcttcgatggcatggccaatagtgtggccaaaattgaggtaaagacgaataccattgtccaactcatcttcaaccaccatcttgcgcttcacctgacaagaatgttcaatcaaggtctctgcatgttccaaaatactctcaacagaaccattcagtcccgtcaagagagcccacagttctggatcctcaatcaagccatacttgataacttcacccatcccttcaatcaactctctttttccgagggtttcaagaacaagtggatcaatcaaaaccccatctggttgggcaaaggtccccaccatatttttagcaaatggtgtgttaacacctgtctttccaccgatagaagaatcaacctgagctgtcaaactagtcggaatctgaacaaagtgaataccccgcatataggtagaggctacaaatcccagccaggtcccaacaacgccaccaccaagagcaacgattccatccgctacgantcngaacttgcttgactagaaattcatacactttctgaaccgtagttaaattctttctttcttcaccttctaagaagtccaaaa

SEQ ID NO: 154 - DNA, 769 bp; single-stranded, linear
ctcacgcagttctgttaccaaagaccgttcaaaaagcaaactagcaatacttataacttattagaaattcctaattttaccttgctaaacgaatacaggtcacgatgccatctgagtctgtgatttccaattggctcgatgtcatccatttgattggtacgtcaacttcttgtgctcgttgggcaatcgttaacagttcttctttatgtgcaacttcgatgacatagtaggctaaacctggtaagccttgcttacgcggaagccagaccttttccttccccattcgttaactgctaaatgatgatggtaatctccagccgcaatccaactagcgccaggcacactgaatttattctctagccctaacaccttttgataaaactggctggactttcgactatccttgacggaaagatgaatatgccccattcttgtaccttctgccaggataaagggctctactctttcccccaactcataaatgtcctgcgccgcaagagcctccgtcactccgataatgcgtccatcttctcgaatatcccatgtggaaactggcttatctcgatagagttcaatgccatttccctccaaatcttccaagtaaatagcttcactgtaaccatggtctgcaccgccgacaagaggaatttgcaaatctgtcagatgtttcaagacatcagccaaagccttgcgtgtgggcaagagaatggccaaatggtaaagaccataatgttccctcacttctccgctcttcttgtgcttgaatcag

SEQ ID NO: 155 - DNA, 686 bp; single-stranded, linear
ctggagattattgagattgcccgtcaaaacgatttgattatntttgcggatgaaatctatgaccgcatggtaaatggacggacatgtgcataacgcctgtggcgagcttggcaccagatgtcttctgtgtcagcatgaatggtctgtcaaaatcccaccgcatagcaggtttccgtgtgggttggatggtcttgtctggccctaagactcatgttaagggctatatcgaagggctcaatatgctgtccaatatgcgcctttgctctaacgttttggcccaacaagtcgtacaaacttccttggggggtcaccaatcagtcgatgaattgcttctttcctggtggacgaatctacgagcaaagaaatttcatctataatgccattcaagatattccaggtttgtctgccgttaaacccaaggcggggctctatatcttcccaaaaatcgaccgcaatatgtaccgtatcgatgatgatgagcagtttgtccttgatttcttgaagcaggaaaaggttctcttggttcatggtcgaggctttaactggcaggaaccagaccacttccgtatcgtttaccttcctcgtgttgatgagttagcccaaatccaagaaaagatgactcgtttcttgaaacagtatcgtagatagggcttgcattcgaaaaagctggaaacatttgcctagag

SEQ ID NO: 156 - DNA, 525 bp; single-stranded, linear
ctaaaaaaagtcaagtagaaaacgaatattctacttaacttgcacgaaattatttttcacgaatgacttcgaccttatatccatcagggtctttgacaaagtaatagtttggtgcagttcctggtagaccatttggctcagtcacttcatagccttttgtactgtgctcttgatgaagtgcctcaagatcaggtgtactgagggcgatatgggcaaacccatcaccaaccacatacggaccgtgatcgtagttataagtcaactccaactcatagtcatcaccctcaagacctagatagacaatcgtgaaggcatggtctggaaaatctctgcgacgcaattctttaaaaccaaaagcatcttgataaaatgcaattgatttttcaagattttctactcgtaagcaagtgtgtagcatttttgaagccatatctttctcctttatttttaaaaagactggacaatcctgttccagtctcatcagttgttatttaccaagttttgctttagctgcatctgcaagag

SEQ ID NO: 157 - DNA, 575 bp; single-stranded, linear
ctagctttgtgtcctctcttctctacggagtggcggttttgattatcgcctgtccttgtgccttgggacttgcaacaccgacagcccttatggtggggacaggacgtagtgccaagatgggggttctcctcaaaaatggaactgtcttacaggaaatccagaaagttcaaactcttgtctttgataagaccgggactttgacggaagggaaacctgtggtaacagatatcatcggcgacgaagtagaagtgtttgggttggcagcctccttggaagatgcttctcaacacccactggctgaggctatcgttaagcgagcgagtgaagctggacttgagtttcaaactgttgaaaattttcagaccttgcacgggaaaggtgtttccagggcgaattaatggaaaacaagttttacttggaaatgctaaaatgctggatggcatggatatttctaatacttatcaagataaactagaagaactagaaaaagaagctaagacagttgtgtttcttagctgttgacaatgaaatcaaagttttgccttgctttgccagatatccctaaagaaatgctg

SEQ ID NO: 158 - DNA, 1003 bp; single-stranded, linear
ctcaatagcaccaatagacagtttcttggttacatcataagcaccaggtgttaccaaagcttcaacagcgtgagtcagagcatccataccagtagcagcagtcaggcctttaggtttggaaagcatgagttccgggtcattaacagagataagagcaaggctattcttgtcaaccattaccatcttaaccttgcgttcttcatcagtaatcacatagttaatagtgatttctgcagaagttcctgccgttgtattgatagccacaactggcaagccttttttagcagacttatgaagcccttcataatcctgtggttttccaccatttgtagccatgatagaaatacaactagctgcatcctgtggagaacccccgccaagactgatgataaagtcacagccatgttcttgcaaagcagctaccccatctgtgacatttttacaagtagggtttggcgtctacatcgctaaagatgacatattcgattccttctgtatccagtggttttaaaaccttaggtaaaatatcactgccttcgatgtacttatctgtcaccaaaagtgcctttttatagccaagttccttgatataaggacccacttcatttacaacaccttttccaataaggttgactgccggaacataaaatgtagccatataattttcctcctgcgcctccgcgctatctatttaacatcattatattactttttgtattcgttttcaattatttgtgaattgtttaacaaatctttttaaaaggataggagggacgtaagttcacctcctatataaacaaggtttatttatgtagtggtcccaataactgacatgcacgatagtctgctgattctagatcttctgttccaaataaggaccaatttttaggtctaaagatatcttcttcgggtacattatgcatattgacaggaattctcaacatagaagccaaggtaatcaagtctgctccaatgtgtccatatgttatggctccgtgattag

SEQ ID NO: 159 - DNA, 715 bp; single-stranded, linear
ctaaagtttctgatgaacttggtggtggatcaattacagccctaccatttatcgagacacaagcaggagatatctcagcctatatcgcaaccaacgtgatttctatcactgatggacaaatcttccttggcgatggcctcttcaatgcaggtattcgtccagccatcgatgcgggttcatctgtatctcgtgtaggtggttctgcacaaatcaaagccatgaagaaggttgctggtacacttcgtatcgaccttgcttcataccgtgagttggaagcctttactaagtttggttctgacttggacgcagcaacacaggctaagttgaaccgtggacgtcgtaccgttgaggtcttgaaacaacctgttcacaaaccattacctgttgagaaacaagtaaccattctttatgctttgacacatggtttcttggatactgttccagtagatgatattgttcgtttcgaggaagagttccatgccttcctttgatgctcaacatccagagattttggaaaccattcgtgatacaaaagacttgccagaagaagcagtcttggatgctgcgattacagagtttctcaatcaatctagcttcccaataagaatagaagtgtcagatggcagtgtctctaaatgatattaaaacaaaaatcgcctcaacaaaaaatacgagtcaaatcactaatgccatgcaaatggtatcggctgctaag

SEQ ID NO: 160 - DNA, 1087 bp; single-stranded, linear
atcaaagagcctatgtgcaggctggggcagggattntctagatctatcgcccaaaacgaataccaagaaaccattaacaaagcaaaatttatgactagaattggagaactaagaccatgattttattgattgacaactatgattcttttacctataacttggcccaatacattgggaattttgcagaagttcaggttctgagaaatgatgattccaagctgtatgaagaagctgaaaaagcagatggtctggtcttttctcctggtcctggttggccagttgatgctggaaagatggaagacatgattcgtgattttgcaggcaagaagccgattcttgggatttgtttgggccaccaagccattgcagaagtctttggtggtaagctaggtttggctccaaaagtcatgcatgggaaacagagcaatatcaactttgaagcgccatctgttttgtatcaaggtattgaggatggccgtgcggtcatgcgttatcacagtattttgattgaggaaatgccagaagactttgaagtgacagctcgttcgactgatgaccaagccatcatggggattcaacataaaaacctaccgatttatggcttccagtaccatccagagagcattggaacgccagacggcttgtcttctattcggaattttatcgaggaggttgtaaagtgaggaaactaggatgaaagagattattgaaaaactagcaaaatttgaaaatttatcaggtgtggaaatgacggatgtcattgagcgtatcgtaactgggcgtgtaactgaagcgcagattgcttctctcctcttagctcttaagatgaagggggaaacacctgaagaacgcacagccattgcccaagtcatgagaggacatgcccagcatattccaactgagattcatgatgctatggacaactgtggtacaggtggggacaagtctttcagttttaatatttccacaactgcagcctttgtcttggctggtggcggtattcacatggccaagcatggtaaccgctcgatttcttctaaatctggttccgcagattcctcnaaccttgggaatcaatcttgacctc

SEQ ID NO: 161 - DNA, 1089 bp; single-stranded, linear
ctctgcttgcttttgttgcttggaattttgtcaccttttttctttgcccacctactcgaaatgaaatttcttatcaacatgctgctcctacttttacaggagttacggcatttttgatgtattttttttatcctgtgattgcaggtcccatttttgaagacatgatttatcgtggattagtgatgactgctctggaaaaaggaaagaaatgggggctagatgtacttggttccgctgttttatttggggtctcgcacattagtaatcacggttgggtcttgacagactttgtcttctatatgggtggaggtcttatatttgcagtcttatttagaatgacaaagtcaatttattggcctattggactgcatatagtctacaatggcattggtcagcttttgatgttactgtaattttggttgttagtagtatcgcggtctatccttggggaaagcttcccatttgaatttaagaaggagttgtgatgaaagtatttcttcaaaatagagattttagacaattaaccatcaaccagtggatttcaacgcttggggatacgattttttatctggccttcctgaattatgtggcagatacatcttttgcccctttggcgattttactcatcacgatttcagaaaccctgccccaagttctacaaatctttctgggagttttggcggattttcaacatcatcgtgtcttgaaatacacagtcattagttttgcaaaatttttgctttactctatagtgtccctatcgctttcagggcagtctttttccttgttgctagtaacctttatttgtctgcttaacctcttgtctgacacattgagtgctttttcaggcgccatgctcactccgattttcattagaattattgggcaagaccatctggcagaagctattggatttaaacagtcaactgttagtttagtgaaaacaaccagtaatatcccaggaagaatcttactaggcattctatccatccagtttatttccttactgaacgctcttacctttttaatcgcatttttaggtatcctcttcataaaaactgacctcttgaaagtagaaaaaacgattag

SEQ ID NO: 162 - DNA, 1269 bp; single-stranded, linear
attcaaggttcattcgcggaccaacatccgttcactttcatttgccatcggtggatggtgcccttccaggaaatggagggtcgtggttatgtcctttcgtcgtcttctccgtcgtgcttctatgcatgggtcaaaaattgggtatcaacgagcctttcctttacaaaactcgttccaactgttggaaaaatcatggaaagctactacccagaagtgcttgagaaacgtgactttattgagaaaatcgttaagaggcgaagaagaatcatttgcccgtacccttcactcaaggtcaacactttgcccaaggcattgtagcagacttgaaagaaaaaggtcaatctgttatcgctggttcagatgtcttcaaactctatgatacttatgggttcccagttgaattgactgaagaaatcgctgaagaagctggtatgactgtagaccgtgaaggttttgaagcagccatgaaagaacaacaagaacgcgcgcgtgcgtcagctgtcaagggtggctcaatgggtatgcaaaatgaaactcttcaaaacatcactgtagaaagtgccttcaactacaatgctagccaattgtcttctaaattggtagctatcgtggcggacaatgcagaagtagaagctgtttcagaaggaactgcctctcttatctttgcggaaacgtcattttatgctgaaatgggtggacaggtagctgactacggacaaatcttggatgagtcaggtaaggttgtggctactgtgaccaatgttcagaaagccccaaatggtcaagcccttcatacagttgaagtccttgcaccgcttgccttgaaccaagaatataccttggcaattgatagcaatcgccgtcaccgtgtcatgaaaaaccacactgcgactcatttgcttcacgctgcccttcacaatatccttggaaaccacgcaacacaggcaggatctcttaacgaagttgaattccttcgctttgactttacccacttccaagctgtaactgctgaagaattgcgtgcgattgaacagcaagtcaacgaaaaaatctgggaagctcttgaagttaagacagttgaaacggatattgacactgctaaagaaaatgggagatcgaattcctgcagcccggggggatccactaattctanancggccgccaccgcggtggaactccacttttntttccctttaatgaaggttaattgccncctggggttancatggcccnaccgtttcccgttttaaattgtatcccccccnaatc

SEQ ID NO: 163 - DNA, 1243 bp; single-stranded, linear
ccgttgatataggcttgggcattgccacagaacttcttaccatcaatctcaaggtcattacggacctgtgaactcagctttaaccccgagttgagccagggtattgataaccggagttgagaagctcttgaagtcaaatgcttattttcatcttctttggagatgatcgtgtagttgaggttatttaaatcgtggtaaacagctccaccaccactaatacggcgaactacctcaataccattttcgcgaacataatcacggttgatttcttcgatagtgttctggtgacgaccaacaatgatagatggcttgttaatccaaagtaggaagatttgatcctcatccaaaaggtgtttaaaggcgtattcttccaaggcaatattaaaagcagtgtcatttgaatgattgataatgtatttcatgatatccctttactttatatgatagagactggaaataaccttccagtctaatctatcttcgttttattttttcttaggtgaatggatggccattcctagaacatctgcaaacgcttcgtacatcacttcaaagtaagttgggtgtccgtggatggtcttcagcatttcctcaacagtgatttccatttcgatgatgcttgatgcttcgtttattaattctgcggctgcaggaacaataatgtgtacaccaaggatttctccgtatttcttatcagcgataacttttacgaaaccttgagctgcgtcagatgcaatagcacgaccgttagcagcaaagttaaacttaccgatggcaacatcgtatttctcacgggcttgttcttctgtcaaacctactgctgctacttcagggagagtgtagatggctgcaggagtcaaattcaatttggcaactgcatgatttcctttaagggcattttcagcggaaacttcacccatgcggaaagctgcgtgagccaacatcttagtaccgttgatgtcacctggtgcataaatgcctggaactgaagtttccatgtattcattgaccttgatacaaccacgatccaattcaaactcaacctctccaataccttcaaggtctggcatacgaccaattgaaagaagagctttgcttgcgatgatattgtcttttccttcaaccttgatacgaagttgaccattttcctcaatgatttcttgcagtttagtaccagtcaagatggtcattcctttacgctcaaggatcaagcgaaggttcttagaaacttccgcatccatag

SEQ ID NO: 164 - DNA, 679 bp; single-stranded, linear
ctgatagtggagactatcttgggtattctaggtagtagaggtatccatttagcagttcaaggttgtgagcatgtcaatcgggctctcgttgttgaacgtcaggtggcagagcagtttgatctggaaattgtcagtgtccatcctactcttcatgcaggaggttcggggcagttggcagcctttaagtttatgcaggatccagttgaggttgaatttatcaaggctcatgctggattggatatcggagacactgcaattggcatgcatgtcaagcatgttcaggttccgattcgccctattttgagagagattggtcatgcccatgtaacggcactggctagtcgtccaaaattaatcggaggtgcgcgtgcgcactatccgcaagacgctattagaaagtcttgagaatgaataaaggagataaaagtgtttaaaaaagaccgtttttcaattcgtaagattaagggagttgtaggctctgtatttcttggaagccttttgatggctccttctgtagtggacgcagccacctatcactatgtaaataaagagattatttcacaagaagctaaagatttaattcagacaggaaagcctgacaggaatgaagttgtatatggtttggtgtatcaaaaagatcagttgcctcaaacagggacagaagcatctgttttgacag

SEQ ID NO: 165 - DNA, 1024 bp; single-stranded, linear
agctctctctcagccattttttcaatatctgctacgatttgttccttggcatagggagggtctaagaaaacgaggtcaaattccccaganaacctgttccaatgccctttctgcatccattttggaggagttgaaattttccaacttccttggtcatctggatattttcagccacggatggtctgagccttacggtctcgctccaccaaaacagcactggacatgccacgcgatactgcttcgatagataaaccaccactacctgcataaaggtccaagactcgtcccacttcaaagtagggaccaatcatgttaaaaatggctcccctaaccttatccgaagtaggtcttgttgtcttgccttctagtgtcttgaggggacgtcccccatagattcctgatacgattttcatactgtttattataccaaattatagacaaaaagagaaagaaaaccgaaccttgcggttcgattctctacaaaatattttcgtaagtatcgcggacttacttgaggccaaacacttgtttgcacttctccgatgtgtctcttgcgaagtaggaacatggccatacgagattgtccaattcctccaccgattgtcaatgggaataggccattcaacaaagacttgtgccattccaattctaagcggtcttcatcacctgtaatttccacctgacgtctaagagtttcttcatctacacgaattcccatagaagacaactcaaaggctccacctaaagactcattccagacaagaatatcaccatttagacccttgtagccattctcagactcgcttgtccagtcatcatagtctggtgcacgtccatcgtgcggtttaccatctggcaactcgccaccgataccaatcaaaaagacggctccaaattcctttacaaatcgcattttccacgttctttagtgtcaagtctgggtagcgttctaccaattcttctgtatggataaaggtgatttgttttggcaagatagactcgatgtcatagcgggcttcaacag

SEQ ID NO: 166 - DNA, 702 bp; single-stranded, linear
cttttttatttcacaacaagttcataacgtgtcttactggtgaaggtttgaccagctttaagaatgacttggcctttaaggtcactgtgaatggcatctggtaaagcttgcgcttcaagagcaatcccattgtgctgtagcattggctgacctcctatgatgacactttcatccacaaagtttgctgtgtagaccacaaagcaaggagcttctgtcttgaaaagcaggaagcgacctgaattttggtcataaaggaatccagcattgtcatggcctgcaggaagggcaaatggatgatccaaacctgatgccagctggatttgctcatcttcttctgcaaagatatccttcaacaaggcaccattgtagatgtgtttgaccacatcacggttggcttctggagttttggcaggaacaccgtcaggagcgattgagtaaatgccctctgtgtttagttggaagacatgacggtcaatcgtctgcgtgaaatcaccagacaagttgaaatagctgtggttggttggattgaccagcgtatcctgatcggtcgttaccttgtagatcgaattcatggaggcaccagtttcttccaagtgataactgatccaaatcttgagatttccagggaaccctcctgtcccatctgtacgctctgtgtagagagtcaagccatgatcgcttacttcttcaacttcaaacaag

SEQ ID NO: 167 - DNA, 677 bp; single-stranded, linear
ctcaatatttcttgtcccaatgttgaccactgtaatcatggacttttgattggtcaagatccagatttggctaatgatgtggtgaaagcagctgattggaagcctcgagtgccagtttatgtcaaattaaccccgagtgtgaccgatatcgttactttgcaaaagctgcagaagatgcgggagcaagtggcttgactatgatcaatactctggtgggaatgcgctttgacctcaaaaccagaaaaccaatcttggccaatggaacaggtggaatgtcaggtccagcagtctttccagtagccctcaaactcatccgccaagtagcccaaacaacagacctgcctatcattggaatggggggagtggattcggctgaagctgccctagaaatgtatctggctggggcatctgctatcggagttggaacagctaactttaccaatccttatgcctgccctgacatcatcgaaaatttaccaaaagtcatggataaatacggtattagcagtctggaagaactccgtcaggaagtaaaagagtctctgaggtaaactgcaatcaatctgttcttgattttttattagtttgtaatatgaatttaggagaattttggtacaataaaataaataagaacagaggaagaaggttaatgaagaaagtaagatttattcttttag

SEQ ID NO: 168 - DNA, 1047 bp; single-stranded, linear
acgcatttcattcaacggaaatggagactacccttgggttggcgtaggcttgccaaagttttctggctagttctggccccatagggaccatattgaacaaaatcagcttcacgttcaccgttttggtctttgtaacgacggttcacagcgatagttgctcgcgctaccgacttgtcattgttggttttgtgcaattctggtgtagacgttaaacgcccaatcatgataactttattatacatattttcttcctcctacttatctattcgtaggaaatcaaaaaagttacagaaatttgtaacttttcgaggaaatttcttattttttatgaatcatgaaacctgtcgcctgttgattggccataatggtcatatctgtaatctgaacacggcgaggctgactggtcacatagactactgtgtctgcaatatcctgagcttgcaaggcttctattccttggtaaacggacgcagcccgctctttatcaccatgaaaacgaacagttgagaaatctgtttcgacaatcccaggctgaatggttgtcaccttgatatccgttgcgatggtatcaattcgcagtccatccgaaaaggtcttaaccgcagccttggtagctgagtaaacaaggcgggcacccaggcataggcggtaggattcctggcgggttgaaccccatattttggataaacggggaccttggattgaacttttaaccattggctgggcaaggaaacagcggagtaaccgccatcagaacctttaacattggtatccaacatggtcaacatatccaactcctcatagtcttgatagggagccaagccaagagccagtccggcgttgttgaccaagatatcaatcctccctatcgtttctagaatatcagagcaaacagtcttcaccatgaccatatccgtcacatctagtggaaaagtccagacggtttgatttggaaagcttactgcaaactccgacttgaaggatttctaatctgtctatccgtcgtcctgttagaacgacatcctcaccctgctccagataagcacg

SEQ ID NO: 169 - DNA, 1165 bp; single-stranded, linear
cttgttggatataaggattgcgagttgcatagcgaagaacaataatcgcggcaaatagcccataaagagaggtagaggcgcctgctgctaaggatttaggactaaatacaaaaacaaagagattgcccatcattcctgataaaagatagagaaagaaaaactgcttagaaccgaaaatctcatatacctgcattccaagataataaagtgaaagcatattaacaatgaaatgttcccacccaatatgaacaaaaatggcagacaagagacgccaaacctgctcgggaaagaggcgaatagctggaccatacatggctccaaatcgaaataatgtatctgccctgtcaaagtttccgcctgcagtgaccaacattagtaaaaataccaaggccgtcactaagaggaagaaactcgtcacagggtaacgtctatcaaagatttccttcatcaattaatacctcctgaacaggaatatcatggttttcaggtataaagtcctgaatttgacaaggatatatcgtactcaaagcacgaccagaaaaatgttccagatagcggtcataatagcctccaccgtatcctatccgatatcctttcgtcgtaaaagccagaccaggaacatgaatcaaatcaatctttgaaacatccacaacttccaaatctccctgtggctccagtaatccaaaggaagtttttaccaactgttgcggatcatagaccacaaagtccatgcgccccttgggataggtcttaggtgtcaaaaccctcttgccgtccttcagcgcctgctcaatcagttcccgcgtttgaaactcatgagaaaaagagaggtaggttgcgatgaccttggcttcttgataaaaggggtgttgtaaaattcgctcggttaaagcttggtctatagcctgtttttgttcttgagataaagccttcatttcatgcaagacttgcttgcgtaattccgatttcatagacaagccctctattctgctgccttctttttcaggaaactagacaccgcagccaccccaatagctaagacttcttccttaggactcatttgagggtgatgaagagcgtagggactatcgatacctagccaaaacatcacaccatcaacctttgaaaggagataaccaaagtcctcgcctgtcatagcaggttc

SEQ ID NO: 170 - DNA, 662 bp; single-stranded, linear
ctgggcgaccttgagagtggctttactggggctgattttgggagttttgattgcctgtcttatggctgtactcgatggatagtttgacttggctcaatgacctgatttaccctatgatggtggtcaatcaaaccattcccaccattgccatagctcctatcctggtcttgtggctaggttatgggattttgcccaagattgtcttgattatcttaacgacaacctttcccatcatcgtcagcattttggacggttttaggcattgcgacaaggatatgctgaccttgtttagtctgatgcgggccaagccttggcaaatcctgtggcattttaaaattccagtcagcctgccctacttttatgctggtctgagggtcagtgtctcctacgcttttatcacaacagtggtatctgagtggttgggaggctttgaggggcttggtgtttatatgattcagtccaagaaattgtttcagtatgataccatgttcgctattattattctggtatcgattatcagccttttgggtatgaagttggtcgatattagtgaaaaatatgtgattaaatggaaacgttcgtagaattagaatgtttctgaaaaagaaaagaggaaatcaaaatgaagaaaacatggaaagtgtttttaacgcttgtaacag

SEQ ID NO: 171 - DNA, 555 bp; single-stranded, linear
ggaattcgatctcttaaagcctattatggttaatccaatttgttttagctgcaggtggaattatgaatgtcggatatgaaaaagcattcttgatgcagacatcgttaaatttgccaacttctgaaattatctcgacatatgtctataaagttggtcttgtatcaggagactattcttactcaacagcggttggtttgtttaatgcagtgattaacgtagtattgcttgttgcagttaaccaaatcgttaaacgcatgaataatggtgaaggaatttaaggaggaaagtatgaaaaattcgattatggatacaaaatttgatagacgtatcttactcttaaataaaatcattattgtctttatcgttttgatgactttgcttcctttactttatatcgtcgtagcatcctttatggatcctaaggttctggttagtagagggattagctttaatccagccgattggactgtagaaggttaccagcgtgtattcagtgaccaatctattctaagaggttttatcaattctctactatactcttttggatttgcagct

SEQ ID NO: 172 - DNA, 860 bp; single-stranded, linear
ctcataatcatattttggattcgcaaattgagggagttatttcaacggccgatattattgacaaagctggaatcactccaatcggagtttatacgcacgaaccacgtgatcaggttccgctggtcattaaggaagtgaatggtatcaaggttgcattgtcagcctattcctatggtttcaatggaattgagcagtatatttctcaggaagactataatcgttatcttttagatttaaacgaagataagatgaaggctgaagttgaacgggcagagaaggaagcagatatcaccattatcatgcctcagatgggtgttgagtatcgattggaaccaactgaagaacaaaaagctctttatcacaagatgatcgattggggagcggatattatctttggagggcatcctcacgttgttgagccatctgaaacggttgaaaaagatggagataagaaactcattatctattcaatggggaacttcatttccaatcaacgaattgaatctatgggagatgaagagaatgctaagtggactgaacgtggtgttctcatggatgttcaccatcaagaagaatgatggaaaaacaactatcggaacagctaaagatcatcctacttgggtcaatcgaacaccaaagggaaccttttcaccagaaggatatcccttgtatcattaccaaacttatattttggaagattttatagaggatggcagtcatcgtgaccagttagatgaagcgactaccggaacgaattgatacccctataaagaaatgaatgaacatgtgggattgaagtggtattactttgaatcccgaggaaagtcctgatgattaaggtaattgcgacagatatggat

SEQ ID NO: 173 - DNA, 1284 bp; single-stranded, linear
ctcatttgcaaaatcaggaaaaacggatggtaacggcagtccgaaatgttctatctaagaaacaagaggctttgaaaaaatgcagtcagtctgttatctttagacaacctgagcgcttgtatgacggttatttgcaacgcttggaccaactgcaactgcgtttgaaacaaagtttgcgaactcggatttctgataacaaacaattagttcaagcaagaactcatcaattagtacaattatcacctgttaccaaaatccaacgctatcaagaccgtttaggacagttggacaagcttcttaggtagccaaatggcgttagtttatgacgccaaggttgctgaggccaagcgactttcggaagctttgctcatgttggatactagccgaatcgtggcgcgtggttatgctattgtcaaaaaagaagaatccgttgtagattcggttgagagtttgaagaaaaaagaccaagtaacgcttttgatgcgagatggtcaagtagaattagaggttaaagatgtcaaaacaaaagaaatttgaggaaaatctagcagaactggaaaccattgtccaaagtttggaaaatggtgaaattgctctggaagatgcgattactgcctttcaaaagggcatggtcttgtcaaaagagctccaagctacgctggacaaggctgaaaagaccttggtcaaggtcatgcaagaagacggaacagaaagtgattttgaatgaaaaagcaagaaaaattagctcttgtcgagtcggctttggaagattttatggagaccagcagtttgcctctagtttacgggagtctgttctctattctattcatgctggtggcaagcgtattcggccttttctcttgttagaagttctggaagccttgcaggttaccatcaaacctgctcncgcgcaggtagctactgccttggagatgattcatacagggagcttgattcacgatgaccttcctgctatggatgatgacgaggatcgagagagggcggaaaaaccaatcacaagaaatccggtgaagctatggccatcctagctggagatgcctcatgcttagacccatatgccttgattgcgcaggcagatccgccaagtcagatcaaggtgggctcgattgccaactcatcccttgcttcaggtagcctgggtatggtggcagggcaagtcttggatatggagggcgaacaccagcactggtctctggaagaacttcagactatgcatgccaacaagactgggaagttactagcctatcccttccaacgcggcag

SEQ ID NO: 174 - DNA, 978 bp; single-stranded, linear
ccactatcaagcatctctcttgcaaactttatcgcactatctccatcacctttataatatacatgaatagtcaatgtcatcttatatcctccaaaatcatccttcaatttttaaaaaacaagtttagatgaggatctaaacttgttttttatgaactaattatctaacgtttcgccattactttcaatcacttctttataccaataaaatgattttttcttatagcgatttatagtcaattgaaacaagaacaagacaaaagcacccataaggtaaacttttgagtgctttgaaacgttgatataatcgtattgattaacgttttgaggcaactgaccttgtcaggttgcagccacatttgtaagcgactaaagtcgcaacaactgtgtcaattgcaccaatttagtaagaaagtataaaaaaagaacaccccgaaaggtgctctgttataagttatagtaattctttcgaattaacgtttactaaattgtgatgctttacgagctttcttaagacctggtttctaacgttcaactttaacgggagtcacgtgtaagaagtcctgcgcgtttcaatgaatcgcggaagtctgggtttacttgaagaagggcacgagcgataccatgacggatagctcctgattgaccagcgtatccaccacctacaacgttaacgaaaacgtcgtatgaacctacagttgaagtaactgcgaatggttggttgatgacaagacgaaggtcagcgtgtgggatgtactcttcaacatcttttttgttaacagtgattttaccagttcctggaacaaggcgaacgcgtgcaacagcgtttttacgacgtccagtacctgcatattgtgcttgtgacatactttattgttcctttccttagataagtcctgaaatgtcaagaacttctggttgttgtgcagcgtgagtgtgctcagctccaacaaatactttcaacttcataccttgagcg

SEQ ID NO: 175 - DNA, 874 bp; single-stranded, linear
cttcgggttgggcagcttattttaaaggcttgctctctcaatacgggatagcctttcctcaggctttaaatggtacctttaatcctcaagcagggacatttgttgatttattgcctattcttgtcttggtcttggtgacttcgcttgttttactaaatgccaaggcagccttacgctttaattcgattctagttattttgaaattttccgctttagctctctttgtattagtaggaatttggaatattaagtttgataattggagcggatttgctccttacggtttttggacaaatctatggagctagcactggtattatggctggtgcgtccttgatgttcttcggttttttgggatttgaatccatctctaatggggggtctgtagatgaagtcaagactcctcaaaaaaatattcctagagggattgtcttatcgctttctatcgtaaccattctctatgccttggtgacccttgttttgactggtgtggttcactatagtcatttaaatgtcgatgatgccgttgcctttgcccttcgtagtgttgggattagttgggcagccaactatgtgtcattagtggctatcttgaccttgattacagtttgtatttcgatgacctatgccctatcgcgtatgatttacagtttagcaagtgacggcttagtgcctgctgcctttaaggaactgacgaagactagcaagataccaaagaatgctactattttgacaggtctagcttcagcagtagcagcaggaatgttcccactagccagtattgcagcctttttaaatatttgtaccttagcctaattgatcctgctggcttatggtctgattcgcttacggaaagaaaaaggaatgcccaaag

SEQ ID NO: 176 - DNA, 551 bp; single-stranded, linear
ctaaccctngacggggccgctatcatcagtcaaacagctaaaaatcttgtctgcaaaagtctcgattaactgagcttttacaaaagccgtatttcctggaataacttggagattgatcatcttatccatcaattcagccgattcgatattgtcttcagccagttgcagactttttacgattgattttggcaattcgtagacataggtgttgtctctcaaaggaattttgacaatacctaactctttgatatctcgggataccgtcgcctgagtggcagtgatacctgcttctttcaaatgttctacaatttcttcttgcgtgccgatttgataatctgtcaccaatcttctaattttttcaagtctctcttttttattcatttttaaattgactatgcgccctctctactgcttctttaatctcagcaagaatctgattgcttgctgacttttcttttttcaaatacactaaaaattcaatatttccatgtccaccttggatgggagaaaagtccaagccaaggactgaaaaactgcctctactgccatag

SEQ ID NO: 177 - DNA, 774 bp; single-stranded, linear
ctcttacaggaagaaactcgtcgtgaccttgctaaagaagtgaagaagttcggcgaaaatgctaaagtggctgtccgcaatatccgtcgcgatgctatggacgaagctaagaaacaagaaaaagcaaaagaaatcactgaagacgaattgaagactcttgaaaaagatattcaaaaagtaacagacgatgctgttaaacacatcgacgacatgactgctaacaaagagaaagaacttttggaagtctaaaaataaacagaaaaactcagttggcattgctggctgagttttattcgaaagaaggaaatatgaatacaaatcttgcaagttttatcgttggactgatcatcgatgaaaatgaccgtttttactttgtgcaaaaggatggtcaaacctatgctcttgctaaggaagagggccaacatacagtaggggatacggtcaaaggttttgcatacacggatatgaagcaaaaactccgcctgacaaccttagaagtgactgccactcaggaccaatttggttggggacgtgtcacagaggttcgtaaggacttgggtgtctttgtggatacaggccttcctgacaaagaaatcgttgttgtcactcgatattctccctgtgctcaaggaactctggcctaagaagggcgaccaactctacatccgtcttgaagtggataagaaagaccgtatctggggcctcttggcttatcaagaagacttccaacgtctcgctcgtcctgcctacaacaacatgcagaaccaaaactgg

SEQ ID NO: 178 - DNA, 1172 bp; single-stranded, linear
cctgctcacgataaggtctttgatgtanaagttcttgttgaaggtaagagcatcggtcaaggccaaggtcgttctaagaaattagcagagcaggaagctgccaaaaatgccgttgagaaggggctggattcatgtatttaaaggaaatcgaaattcaggggttcaagtcttttgctgataagaccaaggtcgtttttgaccaaggtgtgacggcagttgttggacccaatggatctggaaagtccaatattacagaaagtctgcgttgggctttgggggagtctagtgtcaagagtctccgtgggggcaagatgccggatgtcatctttgctggaaccgaaagtcgcaaaccgctcaattatgcttctgtagttgtgactctggataatcatgacggatttatcaaggatgcaggtcaagaaatcagggtggaacgccatatctatcgtagtggagatagcgaatacaagattgacggcaagaaagtccgtctgcgtgatattcatgacctcttcttggatactggattgggacgagattccttctctatcatttcccaaggcaaggttgaggagatttttaattctaagcctgaggaacgccgggctatttttgaagaagctgcaggagttttaaaatacaagactcgtagaaaagaaactgagagtaaactgcaacaaactcaggataatctggaccgcttagaggacattatctacgagttggataatcaaatcaagcctcttgagaagcaagctgagaatgcccgtaagtttttagacttggaaggacaacgtaaggctatttatttagacgttctggttgctcaaatcaaggaaaataaggcagaactagagtcgacagaagaagagagttggctcaggttcaagaactcttgatgagttattaccaaaagcgtgaaaaattagaagaagaaaatcaaacttctaaaaagcaacgccaagatttacaggctgaaatggccaaagaccaaggcagtttgatggacttgactagtctgattagtgatttagaaagaaaattagccctatcgaaactggagtccgagcaagtggccctgaatcaacaggaggcacaagcccgtttggctgctttggaggataagagaaattcactcaacaaagaaaagtctgataaagaaagctcaccag

SEQ ID NO: 179 - DNA, 597 bp; single-stranded, linear
ctgttattcctgctgcagggctgggcacacgatttttgcctgccactaaagctttggcaaaagaaatgcttccaattgtagaccgccccacaattcattttgtcattgaagaagctttacgttcgggtattgaagatattctagtagttactggaaagagtaaacgttctattgaagattattttgattcaacttttgaattggaatatagtcttagaaaacaaggaaagatggaacttcttaagtcagttaatgaatcgactgatattaaagtacatttcgttcgtcaaagttcaccacgtggtcttggtgacgctgttctccaagcgaagtcttttgttggtgacgatccctttgttgtaatgcttgggtgatgaccttatggatatcaccgactcaactgctgtacctttaacaagacaattgatggatgattacaacgcaacacaggcttcaactatcgcagtaatgcctgttagatatgaagaagttctcctaatggtgtgattctccccagaattggaaagttagtaatggcctctatagtgttgatgcctttggttgagaaccaaaccagaagaagcgcctagcaattag

SEQ ID NO: 180 - DNA, 836 bp; single-stranded, linear
ctccctagtgtggtagattaggctattttttggtataataaaagttatggaaatcgaaaaaaccaatcgtatggaatgcgctctttgaattttatgcgggcgcttttgacagataagcaaatgaattatatagagctttactacgctgatgattacagtcttgctgagatagctgaggagtttggtgttagtcgtcaggctgtctatgacaatatcaagcgaacagaaaagattctggaagattatgagatgaaattgcacatgtactcggactacattgtccgtagtcagatttttgaccaaatcttggatcgctatcccaaggatgattttctgcaggagcagatagaaattttaacaagcattgataatagagaataagaggaagaaaaatggcatttgaaagtttaacagaacgtttgcagaacgtctttaaaaatctacgtaaaaaaggaaaaatctctgaatctgatgtccaagaggcaaccaaagaaattcgcttggccttgctcgaggccgacgttgccttgcctgttgtaaaggactttatcaagaaagttcgtgagcgcgcagtcgggcatgaggtcattgatacacttaatcctgcgcaacagattattaaaatcgttgatgaggaactgacagccgttttaggttctgatacggcagaaattatcaagtcacctaagattccaaccatcatcatgatggttggtttacaaggggctggtaaaacaacctttgctggtaaattggccaacaaactcaagaaagaagaaaatgctcgtcctttgatgattgcggcggatatttatcgtccacctgccattgaccag

SEQ ID NO: 181 - DNA, 840 bp; single-stranded, linear
cgggtttcaaactcttctcttgtcttgggcagactgcggttccggaagncttccagataacgttcaatttcatctagcaaatcagaagcaggattggtctggctcagttgacctgcaatttttgaaaagagttgcgctaagatcaggctttcactggcggcaaggtgacaagtgttaatctgttgggccatgtttctcagggatacgactttgtcgttgtctcatctcaaagtagtggatatggtagtcggtctggtgaaagaggtggtcagagtgatccaaatagaccagtctgagggcttctttcaaaagcgtgtctaattctgctaccagctgtgctcggttgcgtccgtctcctctggataaatagtatttgaagcgctggaggatatcttttaacttttcttccaccagcgtgtggtagtgctggatttcctcttctcgtgaaggcatatagagattaacaagcaaggcaaatcctgtaccaatagcaaagagaaggaattcattgactagaaggtctggagaggttgactcttgaaccaagagatggctaaccaaaacagtgcttggtgtgatgccaatttcccagcccatcttgtaggctaaaggaacgtagaaggccagatagaggccgagactccagatatgaaatccgctcaagtgaaaagctagaacacccgatagccccgagacctagaagcatagaaaaaagacgattgcgagccagttttaaagtacttctacgcgtatcagataggctcaagagagcgatcattccagccgaaactgctgatgaaagattgagaaaataagcaagcaggcaggcaagacaggtag

SEQ ID NO: 182 - DNA, 1168 bp; single-stranded, linear
ggatggaattgttagcaaatgccaacaaaatcatggaaggaaaagttgtgctaaattgggatatccaataccttggctggggtgactatggtaaggaaaatgtcagttatcaacatcatctggtgaaaactatgatatcgcctttgcagataactatattgtaaatgctcaaaaaggtgcttatgctgacttgacagaattgtacaaaaaagaaggtaaagacctttacaaggcacttgacccagcttatatcaagggtaatactgtaaatggtaagatttatgctgtaccagttgcagccaacgttgcgtcatctcaaaactttgccttcaacggaactctccttgctaaatatggtatcgatatttcaggtgttacttcttacgaaactcttgagccagtcttgaaacaaattaaagaaaaagctccagacgtagtaccatttgctattggtaaagttttcatcccatctgataactttgactacccagtagcaaacggtcttccattcgttatcgaccttgaaggcgatactactaaagttgtaaaccgttacgaagtgcctcgtttcaaagaacacttgaagactcttcacaaattctatgaagctggctacattccaaaagacgtcgcaacaagcgatacttcctttgaccttcaacaagatacttggttcgttcgtgaagaaacagtacgaccagctgactacggtaacagcttgctttcacgtgttgccaacaaagatatccaaatcaaaccaattactaacttcatcaagaaaaaccaaacaacacaagttgctaactttgtcatctcaaacaactctaagaacaaagaaaaatcaatggaaatcttgaacctcttgaataccaacccagaactcttgaacggtcttgtttacggtccagaaggcaagaactgggcaaaaaattgaaggtaaagaaaaccgtgttcgcgttcttgatggctacaaagggaaacactcacatgggtggatggnaacactggtaacaactggatccttttacatccaacgaaaaacgttacagacccaaccaaatccgaaaaattcctaaagaaaagaaatttngggcagaaagcctaaaagaatcctccccagcgcctttggaattttatcctttttaaataccttggaacaatgttgaaa

SEQ ID NO: 183 - DNA, 737 bp; single-stranded, linear
acttctggagcaagtgacacgatcttcatgaaaccaccttcacgcaattcacgtgcaactgggccaaagatacgtgttccgcgaggagttttgtcttcacggatgataactgctgcgttttcgtcaaatttgatgtatgaaccatcagcacgacgagcacctgatttagtacgaacgataactgctttaacaacgtcaccttttttaaccgcaccaccaggagtagcttgttttacagatgccacgataacatcaccgatgtttgcaaatttacgtcctgaaccaccaagaactttgatagtcaagatttcgcgagcaccgctgttgtctgcgactttcaaacgagtttctgtttgaatcatttcagttttctcctttcaggtttgattagatgatgaccgcttcttcaacaacttctacaagacggaaacgttttgtagctgaaagcgggcgagtttccatgatacgtacgatatcaccttctttggcaacattgttttcatcatgagctttgtattttttagagtagttaatacgtttaccatagactgggtggttacgttttgtttcaactacaactgtgattgtcttgtccattttgtcagatacaacacgtccaacaagaactttacgattattgcgttccattgaaatttctccttccctagtctattatttcgcttcagattgaactgttttgatacgagcgatttgttttttaacttctttcaagcgag

SEQ ID NO: 184 - DNA, 740 bp; single-stranded, linear
caagcaattggcgcagttgttcattttctgtctttaaactttccacctcatttgatttaacttctaattggtaaagctgtttcttcaaactttcattttcattatatgttcgtgtcaaatgagccaaatctgatttgacagaatcaaaccactgaaaaggtttttgtacaactctatcaaccaatgagattccatctcctaattttgtcacaattgtacttgaataagtcgtcgctaagagagctgacacaagcagaacagtgacaaaaacaataatgacatattttgattttttaaaacggttcatatccctacctttatatcaaaaactgttacagtaactttttatcaattcctgaaagctactaagattttaagaaaaataaacaacaaccaagtacgagaataacaagaatggtcagcgtatcctttagagtccatttcaattgtcggtattgacttctgccttttccaccctgatagccacgcgcttccatagcgatagccaaggaatctgcacgttttaaacttgtcgcaaaaagaagaatcaaaatgggaatcatcgcctttactttttgaacgatgcttccttctccaaaatccactccacgaggctttctgtgcattcaaaatccgagtcgtatcatccatcaaggttgggacaatacgcaaactcatagacagcatcaatccaatttcatgaactggaactttcacacgctttaaaggtgctaataaag

SEQ ID NO: 185 - DNA, 567 bp; single-stranded, linear
acctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattaggatgcaatatttagaaaaaaaagaaattaaagaaattcaactagccctgctggactatattgatgagacttgtaagaaacatgatattccttattttctcagttatggaaccatgcttggagccatccgccacaaaggtatgattccttgggatgatgatattgatatttccctttatcgtgaggattatgagcgtttactgaagattattgaagaagaaaatcaccctcgctacaaggttctttcctacgatacatcttcttggtacttccataatttcgcatcgattttggacacttctactgttatagaagaacatgttaagtacaagcgtcatgataccagccttttcatcgatgtctcccattgatcgatttacagacttgaacattgtcgacagag

SEQ ID NO: 186 - DNA, 564 bp; single-stranded, linear
ccttgcgtgtagcttacttcaaggttcaccatcctatttattactactgtgcttacttctccattcgtgctaaggcttttgatatcaagaccatgggtgcgggcttggaggtcatcaagcgcagaatggaagaaatctctgaaaaacggaagaacaatgaagcctctaatgtggaaatcgatctctatacaactcttgagattgtcaatgagatgtgggaacgaggtttcaagtttggtaaattagatctctactgtagtcagacgacagagttcctcatcgacggggatacccttatcccaccatttgtagcaatggatggtctgggggagaacgttgccaagcaactggtgcgggcgcgtgaagagggagaattcctctctaaaacagaactacgcaagcgtggtggactctcatcaaccttggttgaaaagatggatgagatgggtattcttggaaatatgccagaggataaccagttgagtttgtttgatgagttgttttaaaaaattgcttaataatctattaaaagaagctaacgtatatccaatagatttacattag

SEQ ID NO: 187 - DNA, 564 bp; single-stranded, linear
cgaagttatcttggtggatgatgtgctctatacaggtcgtaccatccgtgctgctattgataatattgtcggtcatggtcgtcctgcgcgtgtgagtttagcagttctagtcgatcgtggacatagagaattgccaatccgtccagattacgttggaaaaaatatcccaaccagtcgttctgaagaaatcatcgtagagatgacagaacttgatgaccaagacagagttctgattactgaagaagcttagaaagttaaaggagtagccatgtcagaaaatcaacaagcattgaaccatgtggtgtccatggaagacctcactgttgatcaagtaatgaaattgatcaagcgaggaattgagtttaaaaatggagcccagattccctatgaagaccatccgattgtttccaatctcttctttgaggattctacacggacacataagtcctttgaagtcgcagagattaaacttggattggaacgacttgactttgatgtgaaaactagttcggttaataaggggtgagacactttatgacaccattttgactctgtctgctttag

SEQ ID NO: 188 - DNA, 727 bp; single-stranded, linear
tttaagttccaattgtaaactcacgttcctgaacctggttctccattttcagagatttccggtgcaggattttttggtgtcgcgaaacgaatatttccacgtccaccacgaccaccgtgggcaacgataaattcttgcccatgttcaatcaaatctgttaaaaccttgccagtctccgcatcacgaacagtcgtaccttgtggtactcgaactctaaggtcctcagcaccacgaccatgcatccctttggtcatccctttttcaccagaatcagccttgaaatgacgattgtagcggaaatccatcaaggtacgtagtccttcgtctacaacgaagaccacattgcctccacgaccaccatcaccaccccaagggcctccattagggacatatttttcacgacgaaaggcaaccataccatcgccaccattaccagccttgaccttaatcttagctgtatctaaaaacatactcattatttcttctcactttaaaaaagggctgggaaatcccagtcactaaattttcttgaatctattttatagattactgagggcaccaattgcagttgcaaaaattcccaataaacttgctactagcatgataatcacgataaacaaggttattttctcaaacatagtttttttacgatttccattatctccaaattgccatttttctctccttccgttacattctattttctattatcttagcatgaattgag

SEQ ID NO: 189 - DNA, 1071 bp; single-stranded, linear
ctgtgataaaggcaaatggaaggaactagataaactgggacttaaaaccagtagcaatcatgtaagatgagtgttccaaacaactggaagcaaaggagggcaacagatacaggcattcccaaaatcaatggtaccaagatggtcgcaccaaacatggcgaaaacgtgttggaagctaaggagaattccttttccatccgaaggacgttggtcaacgtctagtaacaaatcaacagttgattcttgtttcatataaacctcacttttgggcatcagaaaagagcccattattttacagcaataggccctcagagtaagacttctctaaaatctagactttaaagagtttcaaatatttttgcgtcttcgtcacctcacgggatgacattaaaaacctttgcttaggatagtatagcagaaaaaaatgattttgtaaatcattttttcccgagcctagaaataaaagagcgaggctgattttgtaaacatttgtttactaaaaaatttaaagtgggcgtttatttggcataccagccttacgtggatatttatttggtgtttcttttttcttttctaccactgtgatatagcgcggatctctattcggtagggcgtactgagattgtcttcgaccttactaaaaaggagattgagggcattcttagcttctaataattcctcaggcgcattgatggccttgagtgccaatagtttgccaccaaccttaaggtagggaatagtcaattcagataggacctgcatacgggcaaccgcacgagctgttacaaaatcatattgagcacggaagttcttgtcttgggcaaaatcttcggcacgtccgtggtagaaatgaactccgttcaaatccagttcttgagccaagagttgtaggaagttgatgcgcttattgagtgaatcaataatggtcacatctaactccggatagagaattttcattggtagactaggaaatcctgccccagccccgatatcaagaagtttgatagtttcattgggaatcaaaccttgaagaatgggtgcaatcgaatcgtaaaaatgtttgagataaact

SEQ ID NO: 190 - DNA, 827 bp; single-stranded, linear
ggaacgtcgctatcaaatagaagcacaacatattgagcgaatttttagccattttgacgccgatatggctatattccctgaactagctaccaatattcagaggtgagcaagaaaaccagagaatcaaactattgttttcatcaagttggacttttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgctcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgtactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaattattttatataaaatcacccctctagtgttcataaactagagggggaatttgtatcctactatcgtttaacgcacttctgcattgactttttcttccgagagacgcttggattttttccatgtagcgtgcgacttcctncgtccgttaag

SEQ ID NO: 191 - DNA, 807 bp; single-stranded, linear
caggggatgccagttgatttgcttcaagttgacttgactcgtacttgggaaatcctcggagaaatcactggggatgctgctccagatgaactcatcacccaactctttagccaattctgtttaggaaaataagaaaaatccatgatccttcattcggtcatggattttattgtctttattagtaatctggtcttaagacccctgttacagttgccttagttgcttcgtagtcgccatctacgacaaccttgataatgcgtttgacatcttcttctggtgctggaacaagaggtagacgagtgggtccagcttcaaatcccatatagttaagaattgccttaactggagcaggacttggataagagaagagagcattaaccttaggaatgaatttacgctgaattgctgcggctttcttcatatcgctttctgcaatggcagtaaacatctcgtgcatttcatccccatttgtatgagaggcaacagaaataaccccatccgccccaaggttcatggcatggaaagcatctccatcctcacctgtataaatcaagaactcttcaggcttgtgctcaatcaagttaagccatattagccaagctagttacattcctttgacacccgataatatttggatggtccagcccaagcgaagcatggtttcctggagttcaattcgacaactacacgcccctggaatgttatagataataattggtaggtcagaagcatctgcaatagccttaaagtgctgatacatcccttcttgagaaggtttgttgtagtaaggaacaatagcaagcccag

SEQ ID NO: 192 - DNA, 1191 bp; single-stranded, linear
cgtgccttggccaatgatccaaaaatcttgatttcagacgagtcgcttcaaatttcggcccctggacccttaagaccaacccaagcagattttggcccttggttgcaagatttgaaccaaaaattaggcttgactgttgtcctgattacgcatgaaatgcagattgtcaaagacattgccaaccgtgttgcagttatgcaggatgggcatttgattgaagagagtagtgtgcttgaaatcttctcagaccctaaacaacctttgactcaagactttatctcaacagctacaggtattgacgaagccatggtcaaaatcgagaagcaagaaatcgtggaacacttgtctgaaaacagtctcttggtgcaactcaagtacgctggatcttcaacagacgagccacttttgaatgaattgtacaagcattatcaagtaatggctaatattctctatgggaatatcgaaatcctcgatggtactcctgttggagaattggtggtggtcttgtcaggtgaaaaagcagcgctggcaggtgctcaagaagccattcgtcaagcaggcgtacagttaaaagtattgaagggaggacagtaagatggaatcattgattcaaacctatttaccaaatgtctataagatgggttggtctggtcaggcaggctggggaacagctatctacctaaccctctatatgacagttctttccttcattatcggaggcttcttggggctagtggcaggtctctttctcgtcttgacagcgccaggtggtgtcttggagaataaagtcgtattctggattttagacaaaattacctcaatttttcgtgcggttccctttatcatcctcttggcaatcttgtcaccactttctcacttgattgaaaaaacaagtatcgggccaaatgcaagcccttgtcccactttcttttgcagtctttgccttctttgcccgtcaggtgcaggttgtcttggctgaattggatggcggtgtcattgaggcggctcaagcgagcggagcgactttctgggacatcgtgggtgtttacctatcagaaggtcttccagatttgatccgtgtgacgactgtgaccttgatttcccttgttggggaaacagctatggccggtgcggttggaggcgccgggaaaagcggtttgcgttattgggcgctcttccgcttcctcgctc

SEQ ID NO: 193 - DNA, 682 bp; single-stranded, linear
ttcaatgggccctgtaaggctgccaaaaagagaaaccaattaaaaccgcgccagccgccaaaatccttgggcatttttagccagcatgggaaaagtgatagtgactggccaaatccaccacattttcgatagcagaattgataatttcaaaggctaccaccaagaaaatgctcaataggagaaagagccattcgattcgtgacacctgaaaaccaaaacctgcaaggatgaccactagagccgtcactgcatgttttcgcatattgcgttcttccttgatagcagtaaaaatccctgtgatggcaaattctaaactggatatcaggtcacgatttttccattttcgtttattgtcttgtgagtccataggctgtcaaaatttcttcttgtaaaccgaacatctccgcttcttcttccggagtatagtgatcatagccgttaatatgtaaaaagccgtgtactgccaagaagcccatctcacgctcaaagctgtgaccatattcttcggcctgctcatgagccttatcgatagagatgaacaattccccaatataggcatcaaactcagacatcatctctgccaattctggattttcaagcaaatcctcttcgtcaaaggcaatttccaattctggtttatactcaaggctgatgacatctgtcggacggtcggtgtcacggt

SEQ ID NO: 194 - DNA, 1094 bp; single-stranded, linear
ctacttctgtaaattctttataaatgacatttccatttctttccacagtcaccagcatttctgttggattataatccaaattaaataattcttcaaaaaactttatcttttcatgataatctgcaatgtcagaaagattatttttattaacactcataacactagccccttatttttcagtaaactctccgtctacgacgtcatcgcctgcgtttcctgttgcttgtgcgccttctgctccttcttgagcttgttgcgctgctgcggcttgttcgtaaagtttcacagcaaggccttgagctttttcgttcaacgcttcaagtttcgctttcatgtcgtccaagttgttgtcttcttgagctttcttaaggtcatcaagggcagcttgggcagcgtcacgttctgcgtcgaagcctttaccttcagtttccttgattgtcttttcagtcgcaaagattgcttggtctacttcattacgaaggtctacttcttctttacgtttcttatcagcttcagcgtttgcttcggcatctttcatcatgcggtcgatttcttcgtcagtcaaacctgagttcgattggatgacaatagtttgttctttttgagttccaaggtctttggccttaacagacacgataccgttcttgtcgatgtcaaatgttacttcgatttgaggaattccacgaggtgcagctgggatatcagtcaattggaagcgtccaagagtcttgttatctgctgccattgggcgttcaccttgaagaacgtggatatcaacggctggttggttgtctgctgctgttgagaagacttgtgatttagatgttgggattgtagtgttgcgatcgataagttttgtaaatactccacccattgtttcgataccaagtgacaatggcgttacatcaagaaggacaacgtccttgacatcaccagtaatcacaccaccttggatagccgcacccatagcaactacttcatcagggtttactgatttgtttggttctttaccagtttcagctttaacagcttcaacaacggcagggatacgagttgaaccaccaacaaggataacttcgtcgatttctgacaag

SEQ ID NO: 195 - DNA, 793 bp; single-stranded, linear
ctctgggttccattcttgtggctgtaatactaggaatttttctaggatttttctggcaagaaccgattcagaaagaaaatcgtctggcttgtcatgagcatgatttttcttaacttgagttctgcaaaaaaagtttttcaagtctttgtgcaggccattgatgaattttttgatacggggcgttatttggtatttggctgcctctttgcttctataatacaggtctacgttccgactcggattctgacctctatcagtgcgacccctctttttgccatcctgctcttgatgattttagcctttcttctttcgctctgtagtgaggcggatgcctttataggtgcttctcttctctcgagtttcggtttggcaccagttctggcctttctcgtcattggtccaatgctggatatcaaaaatattctcatgatgaaaaattacttgaaagcacgatttatcagtcacttcataacaattgtaactcttgtcgtcttagtctattctctcttgattggagtcatcctatgattcgatttttagttttagctggctattttgaactgactatttacctccatctgtcgggcaaactaaaccagtacatcaacatgcactattcctatctggcctatatctccatggtgctttcttttatcttggctatcgttcaattgtatatctggatgaagcaagtcaaaacccacagtcatctgaacagccgattagccaagatgacgagtatttctcttctggctattccacttgtcatcggcttaactttcccaactgttag

SEQ ID NO: 196 - DNA, 894 bp; single-stranded, linear
ttcttccaatccaggaagtnaacttgttccaaccttctgctagtttcccagaatccattctgccnaatttattagctctattctctaatggagaagcacctgaaagtaactgactggatttgtctgctaattgcccagatcctgattgtaattaaccaactcctgctgtcaatctagaagatttttgtgtcaaggtgtttgagcctgaaactagttgatccaaactacctgtcaaggtggcatttttttcacttagttgacttgcgccctgagaaactttatcaacacctgtagtatatgcgtttacacctgatgcaatcgactgactggcaggaactaatttgctagtaacatctccttgtatctctgttaatccacttgacaatcctatcaaagaagtagaagtaataggtgatacttgattagattgattttttaaagtcgaaagattagaagattgattttgtaagttttctaaacttccctgtaaatcttgtactaaagcgacaattgattgagccgattgaatactatcagttgaattttgagatacagaatcacttatctcagtttgttgctcacttgtcaatgattgataagctgctgtcgattgaatattggataatgtagttgttttttcagataaatcacttggtaaagtcactaccatatagtaatcgccatcttccaatcccttctttccttcctcttcatctacaaaatgaaaatccaaggttttattttcttttaaattggacaccatgtcttttcctattgccatagtattaccattataggaagcctctttatcattatttacaactgccacaggtaagtcagacaattgcccatatggctcccacattgatgacaaaaatatgatattgtacagag

SEQ ID NO: 197 - DNA, 627 bp; single-stranded, linear
ctatggcagatctagaccatcctcatatcgttcggataacagatattggtgaggaagacggtcaacagtatcttgcaatggagtatgttgctggactagacctcaaacgctatatcaaggaacattatcctctttctaatgaagaagccgtccgtatcatgggacaaattctcttggctatgcgcttggcccatactcgaggaattgttcacagggacttgaaacctcaaaatatccttttgacaccagatgggactgccaaggtcacagactttgggattgctgtagcctttgcagagacaagtctgacccagactaactccgatgtttgggctcagttcattacttgtcaccagagcaggcgcgtggttctaaggcgactgtgcagagtgatatctatgccatggggattattttctatgagatgttgacaggccatatcccttatgacggggatagcgcggtgaccattgccctccagcatttccagaaacccctgccgtccgttattgcagaaaatccatctgtacctcaggctttagaaaatgttattatcaaggcaactgctaaaaagttgaccaatcgctaccgctcggtttcagagatgtatgtggacttgtctagtag

SEQ ID NO: 198 - DNA, 729 bp; single-stranded, linear
ctatgctagcgacagctattcttggtgtcgtgattgagtttcttgcttaccgacctttgcgccactctactcgtattgctgttttgattacggctattggggtttctttcctattggagtatggaatggtctatctggttggtgccaatacccgtgccttccctcaagcgattcaaacagttcgatatgatttgggaccaattagcttaacaaatgtgcagttaatgattttggccatttccttgattttgatgattttgttacaagtcattgtccaaaagactaagatggggaaagccatgcgtgcagtatcagtagatagcgacgcggcacaattgatggggatcaatgtaaaccgtacgattagctttaccttcgctttgggttctgctcttgcgggtgcggctggtgttctgattgctctttattataactctcttgagcctttgatgggggttactccaggtcttaaatctttcgttgccgcagtacttggtggtatcggaattattcctggtgcggctcttggtggctttgtgattggtctattggaaacctttgcgacagcctttgggatgtcagatttccgtgatgccattgtttatggaatcttgttgttgatcttgattgtccgcccagctggtatccttggtaagaatgtgaaagagaaggtgtaaacgatgaaggaaaatttaaaagttaatattctatggttactccttttgttaa

SEQ ID NO: 199 - DNA, 557 bp; single-stranded, linear
ccacagattngacccaaacagtatggtctccgatatgttcagaaattgttangatngcgattggnaagatagcgatggttctggaccaaagtaaagattgtactctttaaaggcaccacctgtgctaaatggcaagtagaaaccaggaatttcgaaccagttggctttaagaactggtgtaaagtcaaccaagccaagagttagtgcgaaaaggtaaccaccgataatggcaaagaggaatggaatgattcgtaggaagccttttccttttgtattgataaaggcagcaattaggaaagtaacaacggctaccagagcatttttccaatttccgtctgctacaagacctgcattggtaacagctgaacctgcaagtccaagaccgataacgatgatcataggaccgataatgattggtggcaagagtttatcaatccattttgttcctacaaatcggatgctggtagcaacaaggacatagaccaaaccagtcaagataacccctgtttgggcagcagatacatccccccccatttctttcatagccagtgacatag

SEQ ID NO: 200 - DNA, 608 bp; single-stranded, linear
cttagtatctagaaaaggagaaataaaatggttaaagtattagcagcgtgcggaaatggaatgggttcatcaatggttatcaagatgaaggttgaaaatgctctccgtaagcttaatcaaacagattttacagtcaattcatggccagtgtcggtgaagctaaaggtttagcagtaggatatgacatcgtaatcgcttctcttcatttgattcaagaattggaagggcgaactaatgggaagttaattgggcttgataacttgatggatgataaagaaatcaccgaaaaactcagtcaagcactacagtaaaaggttggagggggctggacagaaactgagagttatcgtttctgtccttctccctctttaaataaaggaggcagatatgaatttaaaacaagctttaattgacaacgactcgatccgactaggtttagaggctaacgattggaaagaagcagtcaaggtagcagtagatcccttgattgaaagtggggcaattttgccagaattattaccaagctatcattgaatcgactgaagagaattatgggccttactatatcttgatgccaggtatggctatgccccacgctagacctgaag

SEQ ID NO: 201 - DNA, 686 bp; single-stranded, linear
ctgatttcacttgggttagagcatagcctaccgctctctagccacctcaatatcagcattggtcccttaattcaaacctggcgtatcggtttttcagatgccaaggtcgcccagcctcaaaaaattgaatcggtgctgcctctaatcaatcctcatggtatcgagttagattcttctacttctactgtgtttttaaaacagaaaggaatgaagatcgatctaggttgtttagccaaaggatacagtgcggataaggttgcccaatttcttaggaaagagggggtgacttctgccttgatcaatctgggagggaatatcctgaccattggaaaaaatcaggcaagaggggataacccatggcaaatcggggattcaaggacccagccaatcctaggggaaatcatttaatgaccatccctgcttgtcaataaatctgtcgtgacttcaggcatttatgaacgtcacctgaccgtcaatggacaagattaccatcacatttttgacagtcaaacaggatatcctgttgaaacggaactagcgagtctaacaatcatctctgataaatcagtcgatggcgaaatctggacgactcgactctttggagaaagaccggcttctatcctctggcaagtcgaaagtttggagggcatcgaagtcatcctcatcgataaagaaggccacctaag

SEQ ID NO: 202 - DNA, 912 bp; single-stranded, linear
ctctggctacgctcaagacgaacatggtaactttgacaagttctggaatggaacagtcttccatatggtaggaaaagacatccttcgcttccactctatctactggccaatccttcttatgatgttggatgttaaattacctgatcgtttgattgcccatggttggtttgtcatgaaagacggaaaaatgtctaagtcaaaagggaatgtcgtttaccctgaaatgttggtagagcgttatggactagatccacttcgttactacctcatgcgtaaccttccagttggttcagacgggaacctttactcctgaagactatgtcggtcgtatcaactatgaattggctaatgaccttgggaacctccttaaccgtacggtttccatgattaataagtactttgatggacaaatccctgcctatgtagaaggtgtgactgaatttgatcatgttcttgctgaggttgcagaaaaatcaatcgcagacttccatacacacatggaagcagttgactatccacgtgcgcttgaagcagtctggactctgatctctcgtaccaataaatacatcgatgagactgcaccatgggtcttggacaaggatgaagctcttcgtgaccaattggcaagtgtcatgagccacttggcagccagcattcgtgtagttgctcacttgattgaaccatttatgatggaaactagtcgtgcagttttgactcaacttggtttggaagaagtttctagtcttgaaaacttgaagtttggctgacttcccagcagatgtgactgtagttgccaaacgaacacctatctttccacgtctaaatatggaagaagaaatcgcctatatcaaggaacaaatggaaggcaataaaccagcagtcgaaaaagaatggaatccggacgaagttgag

SEQ ID NO: 203 - DNA, 1097 bp; single-stranded, linear
ctattttttattgctgcantacttttcttggcttggtaccttcagctggaccaatgacacctgccatctcaagctcttccatgagacgggtcgcacggttaaatccaactgacaaacgacgctgaatcatggatggcactggctttctgtgtttcgataaccaaagacttagcttcttcaaaaagcggatcaccaccagcatctccatccgaaaattctccttcattttcagaaacctcacctggatcaaaactctcatcgtagtctgcatctgcctgagtcttgatgaagttcacaatgcgctcaacatcgtcatccgagataaaggagcctatggagacgtaactggatgattttcattaatcggtttaaagagcatgtctcctcgaccaagaagtttttctgctccatttacatccaaaatcgtgacgggagtctgttcctgatgaaaccgcaaatgctacacgagatggaacattggccttaatcaaaccagagatgacatcaacagatggacgctgagttgcaagaatcatgtggatacctgcagcacgcgccttctgcccaagacggatgatagcatcttccacttccttgctggccaccatcatgaggtcagccaactcatccacaatcacgacaatgaatggtagcggaatttgcttgtactcagactgggaatcgaactcgtctaccttggcattaaaacctgcaacagcccgaactcccaccttggcaaagagttcataacggtttgccatttcatccacaaccttttgcacagccctgctggctttgcgtggattggtcaccactggcaatctaacaggtggggaatatcactgtagaacagataactcaaccatctttgggatcgaccacccatcctcagtaaatttaacttgatctggtctcgccttcatgagaatgctancaataatgccgttaactgctactgacttccctgaacccgttgaacctgcaactagcaagtggggcattttaaaaaggtcaaaagctcttgcggttccattaacagccttccctaaaggaatttccaagaaattttctgcttcgtttgcgattgttccatagtt

SEQ ID NO: 204 - DNA, 1083 bp; single-stranded, linear
ctcttgcaactggcttgatgagagacactgcttacctatcaatgggtagtgtttcgatggggattggcggttctattgtaaatccagatttcttccaagaatacttaggaatgcgaaatgaatcggtagatatgacggagttcacgcgccgtatggaccgtggtatttatgacccagaagagttcgaacgtgctatggtttgggtaaaagaacatatcaaagaagggggttgaccgaaaattcgtgaggatttgattctttctaaagaagagaaagaaaaacaatgggaatttgttattaagatgttcatgattggaacgtgacttaatggttggtaacccaagacttgctgaccttggttttgaggaagaagcagttggtcaccatgctttagtaactggtttccaaggtcaacgccagtggacagaccattttccaaatggggactttatggaaactttcctcaatactcagtttgactggaatggtattcgaaaaccatttgtatttgcttgtatttgcgacagagaatgattcactaaatggtgtgtctatgctctttaattatctattaacaaatactccacaaatctttgctgatgtgcgtacttattggagtccagaggctgttaaacgtgtaacgggacatactttagagggttgtgctgcagctggcttcttacatctaatcaactctggttcttgtacattggatggtacagggcaagctactcgaaatggcaaacctgttatgaaaccattctgggagttggaagaaagttgaagttgcaggctatgcttgaaaatacagacttcccaccagcaaaccgcgaatacttccgtggaggaggattctcaactcgtttcttgacgaagggggatatgccagtaacaatggtacgtctcaatcttctaaaaggggttggtccagtgctacaaattgcagaaggttatacacttgaacttcctgaagatgttcaccatactttagataatcgtacagatccaggatggccaactacttggtttgctccacgtttgacaggaaaaggtgctttcaagtctgtntatgacgtcatgaat

SEQ ID NO: 205 - DNA, 813 bp; single-stranded, linear
ctctgttattaaagaagataacgctgctatccgtggtatgatcacagcagtatctcacttagtaacagttgaagaagtaaactaatgaagttttaggggatgtgcactgtaccatcccctaaaactagatatagtcatctatgatgacatcgtataggcgagttgatgggggagacaaccttttctcccttatcggcgctagcattttacaaaagaggagaaaataaaaatgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagtaactccagttgttcttatcgaagcaggaattgttaaagctgaaaagtcaggtattaaaattcttggtaacggtgagttgactaagaaattgactgtgaaagcagctaaattctctaaatcagctgaagaagctatcactgctaaaggtggttcagtagaagtcatctaagagaggtgacctatgttttttaaattattaagagaagctcttaaagtcaagcaggttcgatcaaaaattttatttacaatttttatcgttttggtctttcgtatcggaactagcattacagttcctggtgtgaatgccaatag

SEQ ID NO: 206 - DNA, 724 bp; single-stranded, linear
ctgtcgttccatgcgtgccaactgtttctagccccatttcctcaaggacacgtgccacagagtctccaaccgcaggggttggtgccaaactcaagtccacaataccaaactcaacacccagtctctcaatggggcatttggaccaaaccaattggaccggatacggagtgattttaaaaggcagttttctcaactggttttcggcttactaacatcaaagctctgtccacgaactttttccaaagcacgtttcaccacaccaggaccagaaactccgacattgatgataacatctgcttccccaacaccatgaaaggcacccgccataaatggattgtcctcaacagcattagcgaatacaaccaacttggccgctcccatatctgaaagatttgccgtttccttgtataattcgtcccatatctgccacagccgtcatattaataccagacttggttgagccgatattgactgacgagcagaccttatccgtctcagtcaaagcgcgaggaatggaattgatgagaatctcatctcccttttgataacctttttgtactaaggcagaaaaaccaccaataaagtccacaccaatctctttcgcagccttatcaagcgcttttgccagaaccagtagtccgtcgcatctgtcgctgccccaatcagagaaataggtgtcaccgatacacgcttattaacgataggaattcccaactcagccgca

SEQ ID NO: 207 - DNA, 711 bp; single-stranded, linear
ctcacgaaaagcttttgtagaagtatctgtacgacgcaagattgacaatttgtgttgaatcagtgggtgattaataactncaatttncccatttgtggaattccttctttcaatttattcttcttattataccaatattaacggtttaaaaatctcctaaaccatntatntnngataatttttacattagatcagcctctttaagagctgtctgtactgtctcaagtggtaaatgggtcaattctgtccctttttcttgataaaggtattgggcgtagtcgtccattcggtactggttgatataaaccacacgcttgcagccgacctgaagcaattgttttgtacagttgagacaaggaaaatgggttacataggctgtaaagcctttgggaacaccacgctcagcaccttgaaggatagcattgacctcagcgtgaagggtgcgaacacagtggccttcaatgaccaaacattcgtgatcaatacaatgctcagtccctgacaccgaaccattgtaaccagtggaaataaccttattatcttttaccagaatcgcgcccactttagcacgtttacaagtggaacgattcgcaattagtagggcttgggctgcaaaatactcatcccaggccagtcttttttcagtcatctcttttctcctttttctctattttttaaaaaatggtaaacctaaatctgcaatcttttcag

SEQ ID NO: 208 - DNA, 677 bp; single-stranded, linear
ctgtgggaccagnttcagctggatatttcaaaaactaactacttacgggtgattaatgcttttactcaaattgaagcggctaaggcttatttatttgcaaactctgagttttcgggtgcggattgggatacgaaaatttcaagggatattttctgggaagaatctatgcatggtatctatccagagaatgttggggtcaatgctagactccttaatgatgaagctgatttttttgactatctaaatcattctgcgatttttactgcggaacgtgatgggcagacctattatttttatcctattcaggctggggactatttggctacgcctgaaatccaagcatttgctctgaatggggatgaggttattatttacccccaagagaaggattttgaaactcatcgtagttaccagtaccaagacttaacgactcgaggaacagttgagtttcgtagtgtgtgtacacagccacttgataggacttttgcttctgcagcttttcacttgggattattggttaatttagacaagttagaagcttacttagaaacagcaccttttctttaaagtatttggttatgattacaagtttttaaggagacaattttctaagaaaaatcttacagatgaggaagaaactacgattattgaattttccaaagacttactcctactag

SEQ ID NO: 209 - DNA, 1160 bp; single-stranded, linear
gtattcggacgttcgttcgaaccggcctggttgtttcgccggctgcacaatggcattttggaaaatgaataaaaagaattttattcatcttcnaaacgcttaagattctcacacaccacagatgtgttttaaaatcataatattcaatccctctattccagctcgtcaacgataaacatgtgagccatattcatngcttttagcaacgccttatatggattggtatcagattcataatccttcattacatttacatctcctagcttcacaagtatttatatatcatacatcctcatcttcatccttcatataatctttggcagcccactcccacacaggaagtatcacctcaaatacatctctatcaaacatcggggaatggaattccttgggaggctctctatctgtagagtaaagcccaactcctttatccttcttaacttggggaacatctgttgtgccaaacatcatatggctagattcgcgagttggggctccaagaaatatagcattgacaagctgttctctaatattggtagaaagactatcggaacggggttgttgcataacaatacaaacccccatagatagagaccttgctttttgagcaacgatagcaaccatattttcaaaatcttttttagctttactatccatcgaagcaactatgaactatattcttctattaccaaaagtaaaggaggaaggccgaggtctattccaatactatcaaataaatcacttttgttataaatttccatccgcctattcatctcgttaatgtagggacgcacgatttctaaaggcatcctcattagttgttccataattttctacctggaagaccagaaaattttgataatttataaatatctgaaagttttggatcaatcacatatatttttgcatgtctcccaattacggtctgagatatgaaacgagtcaagtaataatatgtaaaaaatgatttcccagcacctgacgcgcccgagataagcattgaaaagttttttctcaaatcgataataaaatcatcatagattttaattttcaaactattatcttcttccagagggagagaggtaatatgtaaacgttcaggctgtctgtatacaaagacatattcaacatgagtagcataaatttctttatatgataag

SEQ ID NO: 210 - DNA, 787 bp; single-stranded, linear
ctggatatgggttacacccaagtctttgaaatagtctagtttttcaatgaaggcttcaaaagtcccaaatggtttggtcaagtcttttgcaatggcaggatctgaagtgaagtcacgcacatgagcttcgtagataacggcgtcttcacgagtcttgaaattgtgaatcttatttggcccataaggccccttaaaaagggatcttgagggccgagttgagctggatctacaaaggcggctttagccactttatgggcatcgtcaatcttggcatcgtcgctattccaagcagcaagagatttagcgtaaggatcgagtgcaagaacagttttaccttgacgctcgatttggtattgataatagtagccagtgaaatctgtgattccgagtttgtttgtgctgtctaaagtttgtttccaagttcctctttcccctttttcgagagcgacagttccaactactttgtcagggtcattcttgtcgtagacaacaacagaaaccttatcagcacttggtgaccaaagggtcaaatcaacttgttttccttcttcttttaggtcaaatcccagtttgccatcatagatcgaatgcctcatctttcaggcgccagggggatccactagttctagagcggccgccaccgcggtgggaactccagcttttgttccctttantgaaggttaattgccccttggggtaatccatggtcatanctgtttcctgtgtnaaattggtancgcncaaaatccnnnnaaatanaaccggaacctaaatttaaacccnggnn

SEQ ID NO: 211 - DNA, 702 bp; single-stranded, linear
cttgtttttattggtaactatactttaatgcgataattgattggacttttgtcaaggagatgtgtatgtttgaagtagaagaatggcttcatagtcggattggtttgaattttcgatcaggtttggcccgaatacagcaagcggtggatttgttaggaaatcctgagcagtcttaccctattatccacgtaacagggactaatgggaaaggatctaccattgcttttatgagggaattatttatggggcatggcaaaaaagttgcgacctttacctcccctcatatcgtatccatcaatgaccgaatttgcattaatgggcaacctatagcagacgcagactttatccgtttggctgatcaggtcaaggagatggagaaaacgcttctgcaaactcctgaccagttgtccttttttgaattgctgaccttggttgcttttctttattttagggagcaggaggtggatttggttttattagaagtgggaattggtggcttacttgacacgaccaatgtggtaactggagagcttgctgtcatcacctccattgggcttgaccatcaaaaaaccttgggtgatagttcctagaaccaatggcaaaccagaaagctggttattttcaaggctggtaagaaggcagtgattgcgaaattgcctccagaagctaggcttgtctgtcagaaaaaagccgaatctttag

SEQ ID NO: 212 - DNA, 622 bp; single-stranded, linear
cctgataactataccatgtgcgttttttctctttcccaaagcggcgaagctccatggcagtcgcaatggtatcaatgcgtttctagcgagctaaaaatcaagggcgtaataatgagcagattgcctttgattcgttgcataagagaagctttcttggataattccatcccacgcgcctcctgagacatcttgatagtaaagaattcttcctgcaaatctggaatatagcgcaaggtcaggctgacagaataagcaatcttatagggcacaccaatttgatttaaactggaagcaaactgactaggatgggttgtcatcaaaaagataatagccagaggaatggtgcaaagatacttaatgaccaaatttagcagataaaagagctcctggctggttagagtgtagacaccgattccctgccaaatcacacttctctctccataaagtccaaccccatactcgggagaaaagagatagaccatcaaaacgtttaaaacggcaaataccgtcgcaaaaacggctacaaaggaaacatctttaaagcgaatttctgataaatagaggagaaagactgaaaagatggcaatcagcaagagcattctggtatcatagctaatcatgg

SEQ ID NO: 213 - DNA, 886 bp; single-stranded, linear
cttatatggagggcttataatggcagatctaaaattaatcgcattggacttggacggtaccttgctgactactgataaaaggctgacggatcgcaccaaggcaactttgaaagctgcgcgtgatcgtggtatcaaggtcgtattgacaactggtcgtcccttaaaagccatggacttctttctccatgagttagggactgacggtcaggaagatggagtataccattacttctaacggtggtttggttcagaaaaatacaggtgaaatccttgataaaacagtcttttcatatgctgatgtggcacccttgtatgagaaaacagacaaattatcacctgccacttgatgccaatctcagaaagaacagtttatcaaatccaatcggaccaagaaagtctttatgccaaattcaatccagctttgacttttgttccagttgactttgaagacctgtctagtcaaatgacctacaacaaatgcgtgactgcctttgctcaagaacccttggatgcagccattcagaagatttctccagaattgtttgaccaatatgaaatctttaaatcacgtgaaatgttgctagagtggtcaccaaagaatgttcataaagcaacaggtttggcaaaactaatcagccatcttggaatcaaccaaagccaagttatggcctgtggtgacgaggccaatgacctttctatgattgaatgggcaggtcttggtgtcgctatgcaaaacgctgttcctgaagtaaaggcagccgcaaatgtagtaacgccgatgaccaacgatgaggaagctgtcgcccgggctatcgaacaatatgtgctaaaggagaactaagatatgggattgtttgaccgtctattcggaaaaaaagaagaacct

SEQ ID NO: 214 - DNA, 671 bp; single-stranded, linear
ctatgagacctaacacaattattctaccaaaaattcaattaaaagtcaattctctatttatggtaggggaatccctgctgaatcgtaaaagcgcgatagatttgttcaacaagaactagtctcattaactgatgaggcaaggttaggcgaccaaaactgacagaaagattggctctattttttacagatgatgacaatcctaaacttcccccaataataaaagtaagagtagaaatccctccttatagaagtttcttctaactgcttactaaattcttctgagaagaaagttttcccttcaatggctaacacaataacgaaatcacggtcagcaatttttgataaaattctctgaccttctatttctaaaatcttttgattttctgattcactggccttatctggtgttttttcatctgataactcaatcatttcaaacttagcaaatctagaaattcgttttgaatactctgcgataccatcttttaaatacttttctttcagtttcccaactgttacaactttaattttcatgactctattctaacatattctctattttttcacatcttattcacaaaataaaaaatagatttcaattaagaaaatcacagtttcaaaagagttatccacagtttgtgtaaaacttttgtgtttaagttataattaag

SEQ ID NO: 215 - DNA, 521 bp; single-stranded, linear
ctgggctgagttttccagatacaaatactgcaaccgcaactgcaatcccccaacccatagtaatcacaatccaacctgcactgttgctcttggtttttggaagaaccacacctgcaacaacaccatttcctagaagaatcaggattaaagtccctaaaaattctccaaataattcactcatcatttttctgtctccattaaaaagaaggggcgggcgacaaggattgctaccctccacctcttttattttttcttaattttttaattctgctaagtcgttttgagcaagagctgcttttacatcagcacggtaagttgctttttcttcttctgtccagtcatagaatcgtcccatttcatccaaaactggctcaacgatactatccaagctatcacgcataaagagcatgtgattggtacgacgaagaaggaagtcaactgggctaagagtcaactcattgcgcattgcatagtgaagggacaaggtgtctgccaagctaagacctggcgcttgttccaag

SEQ ID NO: 216 - DNA, 744 bp; single-stranded, linear
ctggaataacattataacgaccagtcatgtataatggagtttgttctctatcagtatttacgtttacaaagaacttaccatttcctttatttgaatagtctccatgtatgaatacttttgtatcctcaagtacttttctttggatggtgctggatgcgctattacatatctaaaaaattcttttattacttcgctaaagagtaagctttctttattatttacaccataggtataagctgggtgttcaaaattataaactacacctccattaaggtaaacccctaaagcttcttctcctagcatagactctggttcagtcaaccattgtctatctccttgactttttccgatattaccacttgcaaacagtttccatttacctgtctcataccacttccaagtatccatcaaaccaccccattgataagtatgatttgaaagccaaagtcccttcatataactttctgtagttgaatcatttccctcagcagcaggtgtatttttgaacatgaaaataaggttcttccagtacttatcaacagatttctgaaatgctatcttaccgttttttccaaatgctttttctattgcagaaccattattttgttcagccggggcatataaaatatcctccatttttagctgatacttttaagtaatctgccgccttattttcaatatcatttgcccaaatccaataattctctgtactgaaaataccatgcaaatttggatatttttgat

SEQ ID NO: 217 - DNA, 518 bp; single-stranded, linear
ctgaaattttggaagaaaaaatcggtgtagatacagtccaaaaaataggacgcatcttgattttgtttaaacaatctagcaagaaagaaaatcgcaagatttctaagaaagtcaaagaaatctaagatcgaaactccaaataactgtttttatagagaaataaaggggactagcctatgacaatcgaactattgactccctttaccaaggtagagttggagccagaaatcaaggagaaaaaacgcaaacaagttgggattttaggggggaattttaaccctgttcacaatgcccatctcattgttgcggatcaagtacggcaacagttgggactggatcaagttctgctcatgcctgaataccaacctcctcacgttgataaaaaggaaaccatccctgaacaccatcgtctcaagatgcttgagtttggcaattgaagggaattgaaggcctagtcattgaaaccattgagttgggagcgcaagggtatttcctacacctacgaaacccatgaaaga

SEQ ID NO: 218 - DNA, 886 bp; single-stranded, linear
cttgcttngnggctcgcttacttngacccacgtcgctatgacttggcagcagttggtcgttacaaaatcaatagaaaaactcaatgttaaaacacgttgtgttcaaccaaaccattggcaggagccattggtagaccctgaaactggagaaatcttggtagaagctggtacgattatgactcggtagcgtgattgaaagcattgaaagccatttggatggcgacttgaacaagattgtctaacatcccaaacgatgcagccgttgtgactgagcctgttgttcttcaaaaattcaaggttgttgctccaactgatccagatcgcgtcgtaacgatcattggtaatgctaacccagatgacaaggttcgtacggtgactcctgcagatatccttgctgagatgagctacttcctcaacttggctgaaggacttggccgtgtaaatgatatcgaccaccttggaaatcgtcgtatccgtgcggttggtgaattgcttgccaaccaagtacgtttgggactttctcgtatggaacgtaatgtccgtgaacgtatgtctgttcaggacaatgaagtcttgacaccacaacaaattatcaatatccgtcctgtaacagctgcggttaaagaattctttggttcatcacagttgtcacatttcatggaccaacacaacccgctttctgagttgtctcacaaacgccgtttgtagccttaggacctggtggtttgactcgtgaccgtgccggatatgaagtacgtgacgtgcactacactcactatggtcgtatgtgtccaatcgagacacctgaaaggacctaacatcggtttgatcaataacttgtcatctttacggacacttgaacaaatatggttttgttcaaacacca

SEQ ID NO: 219 - DNA, 791 bp; single-stranded, linear
ctctcttgatggctgaacatgcgccaaatgctaagattacaactattgatcgtaatccagaaatgattggttttgccaaggaaaattttgcccagtttgacagtcgcaagcaaatcactctcctagagggagatgcggtggatgtcttatctacactgacagagtcttatgatttcgtctttatggattctgccaagtctaaatacatcgtctttctgccagaaatcctcaaacatttggaagttggtggtgtggttgtcttggatgatatttttcaaggtggtgatgttgccaaggatattatggaagtccgtcgtggtcagcgaaccatttatcgaggccttcaaaaattatttgatgcaaccttagacaatccagaactcaccgcaacattagtgcctttaggagatggtattctcatgcttcgtaaaaatgtagcagatgttcaactgtctgaaagcgaatgattttcagaaaaatttaagaaaaaatagtaaaatagatagagtaacacttatctcaaaggagtagacatgaagaaaaaattattggcaggtgccatcacactattatcagtagcaactttagcagcttgttcgaaagggtcagaaggagcagaccttatcagcatgaaaggggatgtcatcacagaacatcaattttatgagcaagtgaaaaacaacccttcagcccagcnagtcttgttaaatatgaccatccaaaaagtttttgaaaaaacaatatggctcagagcttgatgataaagaggttgatgatactattgccgaaga

SEQ ID NO: 220 - DNA, 708 bp; single-stranded, linear
ccaactcttgaatccgattatttaaattatcaaaatcaaagattgttgtttcagagaagatttttgggtccggtgagaagtgaacagttgttcctgttttatccgtatctccaactatttcaagttatgcgacaacatgaccacgacggtattcttggtaatgaatcttaccatttttgtgaacatgaacgtctaattgagtggaaagggcattaacaactgacgaccccaccccgtgaagaccacctgaaaccttgtatccaccaccaccgaactttcctccagcgtgaaggactgtaaagacggtctcaacagcaggacggcctgtaaattcctgaatatcgactgggataccacgcccatcatccacaacagtaatcgaatcatctggctcaataaaaacttgaatatggctggcaaatcctgccaaggcctcgtcaattgagttatcaacaatttcccagactagatggtgaagaccttcttttgaagttgatccaatgtanatccctgaacgcatncgaanagcctctaagccctctaaaacttgaatttgactggcatcataatcctgtgcctgcagatttctgatttctcctgtcatctaatgcctttttcttatatgtctaatacttgtctcaaattcacgatactggtaaacaagtgggtatcaagtcctgcagcttgacctgcttcgatatcaatcng

SEQ ID NO: 221 - DNA, 542 bp; single-stranded, linear
tttaaattttttntatgnnctcctactacgcggtgactagcatcataaactgtagtatccactagacccctctaaagtatcaacttggtaatccaagaacatgccatcatcacttaaaacttgttttttatctgtatacatttgatgaattttaaaattatatgatggatagcctgtgatagtcacagttattcctgtcaaatttttttgactagtaggaagacccaaagtccctaattttgcaccaatgggctcttctagaattaataaagccaagtcatattcccttgcatccttagaatttaaatttctaaattccttcaaataacaaacttcctttactttgatctttccaaatagttcttgacttggactaacagccggaagaacataaatatcatccgcttctttcccatagtcatgtctgtagttagttgtgagcccgctggtaattaacacattatctttaataaaattcgcacttcccctcccttctacattcattccatcggctactccataatacttagataaaaccatag

SEQ ID NO: 222 - DNA, 1028 bp; single-stranded, linear
ctcgttacccagagttcgctcaacttgaagggcaacttaaagggnttgngcaattgaaaaaacacggaattgaaggtgtagttgttatcggtggtgacggatcttaccacggcgctatgcgtttgactgaacatggcttcccagctattggtcttccaggtacaatcgataacgatatcgttggtactgactttacaatcggttttgacacagcggttactactgccatggacgctatcgataagattcgtgatacatcatcaagtcaccgtcgtacttttgtaatcgaagttatgggacgtaacgctggtgatatcgctctttgggctggtattgcaactggtgctgatgaaatcatcatccctgaagcaggcttcaagatggaagatatcctagcaagcatcaaagctggttatgaatgtggtaaaaaacacaatatcatcgtcttagctgaaggtgtgatgtcagcggctgaatttggtcaaaaacttaaagaagctggagatacaagcgaccttcgtgtaacagaacttggacatattcaacgtggtggttctccaactgcgcgtgaccgtgttttggcgtcacgtatgggtgcacatgctgttaaacttcttaaagaagtatcggtggtgttgcggttggtattcgtaacgaaaaaatggttgaaaatccaattcttggtactgcagaagaaggggcattgtttagccttactgcagaaggtaagattgtggttaacaacccgcacaaagccgatattgagccaagtcttctggaccatttttttgtagatactcatcaggatccaagttatcaggcatgctaacgatttgcacaggcatatcaccaatttcatccaatgctttcaatatcgcggcttgcccagccttatctccatcgtaaacaagaaccaatttcttggttaaccttttcagatgctcaacatgctctcgactcaaggccgttcccatcgacccacagcattttcgattccacccgataggctgcaataacatccatgaatc

SEQ ID NO: 223 - DNA, 555 bp; single-stranded, linear
ctgaagaaaatcagtaaacaagagctggttaacacgcgcttttctcgtttatttgctcattttggacaggaaaaagacggtagttttcttgcccagcgttaccaattttacctcgcccagcagggacaaacactatcgggcgctcatgatctcttggacagcctcattgagcgtgattataacttgtatgctgcgacaaatggcattactgccattcagacaggacgtttggctcaatctggtctagcaccttatttcaatcaagtctttatctcagaacagttgcaaactcaaaagccggatgctcttttttatgaaaagattggccagcaaattgctggatttagtaaagaaaagacgctgatgattggagattctctaaccgccgacattcaaggtggcaataatgcggggattgacactatctggtataatcctcatcacctcgaaaatcacacacaagcccagccgacttacgaagtctattcttaccaagacttgctggattgtttagataaaaatattcttgaaaagatcacgttttaaggagattag

SEQ ID NO: 224 - DNA, 764 bp; single-stranded, linear
ctcataaccgttcaagncgntatcgtaagcaatggcacgaaccttagccaaatcaccttctaattcgtgagcagtctcttcctgtggaagtgtgaatggatggtgggcgctcatgtagcggccttcttcttcagaccattcaaaacatcggccagtcaaccacccaaaggaagttgaacttatcattatcaatcaagccaagctctttagcaatacgtccacgaagggcacccagtgttgcattagccacttcaagcgtatccgccacaaagagaaccaagtccttatcttcaagagcaagcgctgttgtcaattcttcttggataccagtcaagaacttggcaactggtccgtttaattctccatcaaccaccttgacccaagcaagacctttggcaccatactgtttggctacttccgtcatcttgtcgatgtctttacgtgaatagttgtccgcagtcaagggctcgagaccgttgaccacaatcgcttttacagcaagtgcttctgaaaagactttaaagtctacacctttgaccacttctgtcaagtcctgaagcaacatgtcaaaacgagtatctggcttgtcagaaccgtaaagagccatagcatcatcgtatttcatatgaggaacggtagcgttacttcaatgccttttgtttccttcatcacgcgcgcgatcaagccttctgtaatatcttggatttcttgctcagtaaggagattccaagtcgactgagtaattcagctggcggtctccacgc

SEQ ID NO: 225 - DNA, 563 bp; single-stranded, linear
ctgtatgaacaatataggaacgtctccggataaactccttggattaatggagtttcttttggcatggatgaaacaccattaaaggaaattcataatatgtcctgccataaaggttacattgttttctttacacgcatctaccatctcgcgacaatcttgataagaaagcggcaattggttttttcaacagaaaacatttttaccatgctgtgcagccttaataaccggttccttatgaagattatttgggagttgcgacgataacacaatctacttcatcgctagaaaccaactcatctaaggaacttgctacttttgctcccaattcttctgcaatcgcctctgcattatctggatcatagagaagagtaatctctgctccatcattcttttgcatatagcgagccaattcagctccaaaataccctgctccaacaacaccgtatttaaccatgttttttctcctttattttgttaaatcattaatttccaaatctatatactgaactacattgcttaaatgcaattcatttctcgaccacgaatcatatttttcaaacagt

SEQ ID NO: 226 - DNA, 732 bp; single-stranded, linear
actattgagtcactttgggaagcgaacatggagtatatttctccagaaaatgccttggatagtcgtaaccgtcaatggaagatttactcaagaaacttgatttcaccaccaaacttcctcggggcaaatgctcatgtggaagactcattagttgtagacggatgtttcgttgaggggggaaactggtaaaacattcttatccctttcaacaggcgcggcaaagtttcgcgaaaggagcgggaagtcccttggatttcagttatcatggagtggagctatcattggtcaaggagctaagattaaacgtgccattattggtgaaggtgcgattatttctgacggtgtcgaaattgatggaacagatgaagtacaagttgtaggatataatgaagtagtgggggtagcaacagatgaagattgataaatattctgccattttaggaaatacagttggttttcacaatatgtcgacattgacggaccaccgtccagtagcaagtttgccatttggtgggaaatatcgtttgattgacttcccgctttcaagccttgctaatgcaggtgttcgtagtgtctttggtattttccagcaggataatatcagctcagtatttgaccatattcgttcaggacgcgagtggggcttatcaacccttcttagtcattactacctaggaatttacaatacccgtgtagaaagttagtacagttggaaaagaatactaccaacag

SEQ ID NO: 227 - DNA, 508 bp; single-stranded, linear
ctcgtgtgatttttttgcctataaataatttttatcagcctgatatataatatatattatgcaagtgattggaagtgtgataaactaatataacaacgaaaatcttatgagagaataaagctttatcttagataaacttaggaatcaggattttataagattttccaataatattagtgtcaataataagaaaagaggtatcttatgacaacatttactatccatacagtagagtcagcaccagcagaagtgaaagaaattcttgaaacagtagaaaaagacaacaatggctatattcccaacctaatcggtctcttggccaatgccccgactgttttagaagcctaccaaattgtctcatctatccaccgtcgcaacagcctgacacccgttgagcgtgaagtggtgcaaatcacggcagccgtgaccaatggttgtgcctttctgtgtcgcaggtcacaacacccttttccatcaaacaaatccagatgaatgatgacttgattca

SEQ ID NO: 228 - DNA, 529 bp; single-stranded, linear
ctgaacccgtattaataagggcatccaacctggaaatgatcagccaaaattcgccacacaattcatagcagacatgaccttaccaattccactttctacaagaacgacttcatgagaagcaatggttcctgtatgataggtattccccaaaacaacttgctcctgggcattatctaaatgctggaccagataagccagttcttctggcatagcagcaataattcctattttcatttcaattccttttctattacaaaagtttcattgctaaaacaagcaaaatcaagagaaagatgaccgcaaataagattttattcaacttagaattgaagacatttctcttggtattttcaatacgacggcttttatgaatagatggttcgacctgaatcttcaaggtttcctggctaaaaccatgatccttaggattggcataaccaaaacgggaagaagaggttggtaaaatcttagtttcctcattatcatctagcaaaggagagcaccgttgaaattttttcgcctctattag

SEQ ID NO: 229 - DNA, 730 bp; single-stranded, linear
agcttattttgatagaatgattaaaacaaaatctagaaagggaatctatgttacacaacgcatttgcctatgttacaaggaagtttttcaaatcgattgtcatcttcctgattattctccttatggcgagcttgagtttggtcggcttgtcaatcaagggagctactgccaaggcttctcaggagacctttaaaaatatcaccaatagcttctccatgcaaatcaatcgtcgcgtcaaccaaggaacgcctcgtggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaaacgttttggaagtagcttgacgattacaggtgtcaatgactcctctaaagaagacaagtttgtctctggtcctatataaactagtccaaggagagcacttaaccaacgacgacaaggataaaatcttctcttcgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacag

SEQ ID NO: 230 - DNA, 535 bp; single-stranded, linear
ctgacatggtttaaagagattttcaaagagtatcggccatggcccctgcctgcaaactatacatcttgtgataagttcctcccagagccaagagttcctcatgggttccactctcgataatgcgtcccttatccaagacatagatgcagttggcgtcttgaatagtagaaaggcggtgagcgatagcaatagttgttcggccctgtctcatcttcgccagagaagcttgaaccaaactttctgtttcagagtcaatattggctgtcgcttcatccaaaatcaggattttaggctggctggcgactgttctagcaaaggcaagaagctggcgctgcccagtagagaagctcgaaccacgctcggaaacaggggagtcgtacctctgaggaagttcttgaataaaggaatctgcatccacaaaggctgccgcagccttgaacctgctcatcactgatttcttggtacatggcgaaattggacttaatagttcccttatagagaggtcctgcagaaccaaaccgatgttttttctcag

SEQ ID NO: 231 - DNA, 791 bp; single-stranded, linear
cggttaaatcgaaggaacaatcgccatcaggataacagctacccaccctagcgtatcttccagaaaatgcagactcagaatagactcattctttgtctttcccttaccaaccaccagactcgctaacagattgatagtaatcgcaataattcctaaccagagaatcccctcatcattgactggttgcggatgcaaaatcttcgtgacattttccaaaatgactagaacagagcctgttacgagaatcacagctgttaccaaggctcctagcaggctaaatcgcttatagcccaaggtgtactgattgtcttcttcacgattggagattgtttctagaaaagctgatattccaattgcaatcgcatctcccaagtcatgcacagagtcagcaagaacagcgctagaaccaaatactccacctgcaataaactcaacaatggcataagtcaaatttaagaaaaaagccacccaaacagcatattttgccttcatatttctcattcctttgttataatagatttatgaacaccttgttcattatcattatccactaaaactcaaagaaaggatagaagcaaaacgtcagctttattcagttctgaacaatttgccttaagtgtccatatgactaacattgaccgccgtatcagcaaaaccaaaaaagccatctatcaagcttttatacaacttttgaatgctaagggctacgaggccactactgttcaggatatcattgatctcgcagatgtgggacgatccaccttttactgtcacnctatgagagtaaggag

SEQ ID NO: 232 - DNA, 522 bp; single-stranded, linear
ctcaggcgattactaattacatgacttctgcctcaaactttaatgtcgatgaggctagccaattcattcaacaatttacaattacaaaacaaatcgaacaagtagaaaaactattagaggagtagcatggaaactgcattaattagtgtgattgtgccagtctataatgtggcgcagtacctagaaaaatcgatagcttccattcagaagcagacctatcaaaatctggaaattattcttgttgatgatggtgcaacagatgaaagtggtcgcttgtgtgattcaatcgctgaacaagatgacagggtgtcagtgcttcataaaaagaacgaaggattgtcgcaagcacgaaatgatgggatgaagcaggctcacggggattatctgatttttattgactccaaatgattatatccatcccaagaaatgatccagaccttatataaccaattaattccaagaagaatgccggatgttccaagctgtggtgttcatgaatgtctctgctaatgataaaacccc

SEQ ID NO: 233 - DNA, 589 bp; single-stranded, linear
tcggaacaggggataattttcattaataaaacccaaaattttttcatggaggtaaacttttcataaccctttttcaaggaaaaaatggcaacctactagctaataaacaaggagcttttagtggaaaattcggtataaggtaaaactataccctaaccaattgaaatagctattagcgactttctctgaaatatggtatgataaaggatatacaaggagataaaatgaataataatttactggtattacaatcagactttggtctggttgatggtgcggtatcggctatgattggagtggctttagaagagtctccaaccttaaaaatccatcacttgacgcacgatatcacgccttataatatttttgaggggagctatcgtctctttcagacggtggattactggcctgagggaacgacgtttgtatcggttgtcgatccaggtgtcggttcgaaacgtaagagtgtagttgccaagactgcacaaaaatcaatacattgtcacgccagataatgggacgctttcctttatcaagaaacacgttggcattgtagccattcgtgagatttctgaggtggccaactagg

SEQ ID NO: 234 - DNA, 730 bp; single-stranded, linear
ctgagtgaagaaaagtaccaccacgagaaatgatgtctcctactgaagctgcatctaggggatgaatttcaccggcaaccataccagcatatccgtcatagataccaaacacttccattccttctgaaattgcttgacgaacaactgcacggatagcagcgttcataccaggtgcgtctccgccactagtcaaaacagcaatacgtttcatattggtttatgctcctttttcttttaacattctttcttgattatatcacatttgattttaaaattcttctattttccgtatttttagcgataaatcgttttcataacgatttcattcaatttctcctctaattcattggatttagctacaaaatgatggggagaaacgatggttttctgttcctcttcataccggatgatgactgggattgggcctttaaattgttctaaaatacgtgaaatttcttgatccgattcatgatttttcacctgtatccaaaagcgttcagcaactgcttctcttatttcttgtgcaatcatttgcaaacggccatcacgtgattgtatttttccttttacatagtagaaggctccctcttttatttcctgtccaacctgacgatataagtctgaaaagagagtgacatccaattttttcttactatcatctgcctgtaagaaggccatattttcaccctttttggtacgaatcacttttattttctgaacttcaaccaat

SEQ ID NO: 235 - DNA, 823 bp; single-stranded, linear
tgtgatatcttntgcttngaaggnacctaacgtggcggctgtcgctcgaaaccaagcggtcatctccgaggagaaggtattctccttctgggaacagtaaagctaaagttggtgttgtagttgacatcaacngtgaaggcttgggctttttgagcgatacttctaaagaaagttcctttatttccttcaaagcccttgcctgagtaagtgctttggagtttgtcatccttgaagcgtttgatatagtctgctagataaggctcgtccgtttctttgtcattggatgtaggagtttattcatttttcgtaacgaatggtgtcgccaggcattccaatcacgcgcttgacgatgtccttattgccatcttcctcatgggccaccacgatatcaaaacggtcaataggaaggtgttttacaacgaagagaatttcgccatccgctagggtcggatccatggaatgtccttctacgcgaacattgctccaaaaaaagatacgacttaaagctagtaatgacagaattaggaggaacagtccccactcttttaagaaatttttaaatgaattcataacttacctttctaagcgttttttcgctttttcagtgtttttaaagtgcaatttggcgcagaagttgagtccctgcataccataggcttgcaaaatctggctagccaccttgtcagaagccgttccagctccacttggaagctgataacccagttctcgtcccagattttcaagattttccagaaagagatcacgcgcaatgacagaagaaactgcgacagactagtatttgccctcagccttttcttctaag

SEQ ID NO: 236 - DNA, 512 bp; single-stranded, linear
cttctaaaaagtcagcatactgcttttcgctaatatccataaattcaggatcatagaatgaaaaggcttggtctaactggctgtaggagtgtcatggccttggcatagtactcttgatacttagcttcacgtgtatcctggtcattcttcatatgagcataaacgtaaagcttctccatctggcgttccatttcaagagaaaattcagtgatttctagtaggttatccgcactatccaagagatggccttcatactgggctactgtctccaattgttctgttaaatcttttaaggcttcttcccaagcctggtcagttgggtagatcgttgatagatcccatgtatctttttcatttatttcatttctttgtaataccattagattcctccatcctttctattctaccatatttttcaagaaatattgctgataaaaggctggtggataaagcttttgccaatcattttgaggattttttgggtaataaggtataaaagtgctgaataataa

SEQ ID NO: 237 - DNA, 544 bp; single-stranded, linear
ctaataataacgattttatgaccaagatggtcatggtctgattgagtgagcccgcgatagagtcgaagagtcgaatggctgaagcatttgggacaacgctggacaccgcagattgattcataagcaagcccgcctgactttcgatactagttgcactggtatcccttaatgagaccagataagtgttggcttggggtagctgtccgtaaagttgctcatagctagcctgactcatataaataaagtgaccaacgtagttctcagtaatagcagcgacctttagttcctgaccttcaatttataaagtctgcccaaccttgacacctgccagctgggcgagtttagctgtaataacgatgccatcttttaatgtcagctcctgctgatgatgttgaagatggataaagggagtcaaatcttccttctctatcatcataagagtaatgttttgaagaccagccttgcctttgaaatccttgtctagcgttttagaatagattttctggtaggctagtatctcctgccctttcaacacttctgctag

SEQ ID NO: 238 - DNA, 814 bp; single-stranded, linear
ctggctttgtttgatgaaaaagatcagtttgtccaaacagtgaccatcgctagccaccgtaaacagaagaactttgacattattaaattcaaagatatgtaccatatcaatactatcgaaaagtacaagggatacagtctcaaggtcgctgaggaagatttgaatgacctagacgatggtgaattttactatcacgagattatcggtttggaagtctatgagggtgatagcttggttggaaccatcaaggaaaatcctgcaaccaggtgctaatgatgtctgggtggtcaaacgaaaaggcaaacgtgatttgcttttaccttatatcccaccagtggttctcaatgttgatattccaaataaacgggtcgatgtggaaatcttagaagggttagacgatgaagattgatattttaaccctctttccagagatgttttctccactggagcactcaatcgttggaaaggctcgagaaaaagggctcttggatatccagtatcataattttcgaaaaaatgctgaaaaggcccgtcaagttagatgatgaaccctacagaggcggtcagggcatgttgatcagagcacaacctattttcaattccttagatgctattgaaaagggaaatccgcgcgatattgtcctcgatcctgatggaaagcagtttgatcaggcttatgctgaagatttggctcaagaggaagagctaatctttatctgtgggcactatgagggttatgatgagcgcattaagaccttggtaacagatgagatttccctgggcgagtatgtcctcactggtggagaattggcag

SEQ ID NO: 239 - DNA, 727 bp; single-stranded, linear
ctatattgtanactttctgatcaaattgactaggtaaaatcaccccataggctgtcagagtcccacttccacttcctgcgtagcccatatctcgctgggagaggatttcagccgaatccacaaaaccagtaatggtataagtatggtcttttaaagaggaatgaccctcttctttttctttaaaactaatctcctgtcccacgctgtattggccttgcaaatgagtggccaaagcgatttccttgtctgactgaggaagtcatccctttcttagctgaaaggttgaaattcgctctggtttggagtacagccgaatggcatcctgcccattatccatagtcacatctgtcaaatagccaaactcgacctctgcgccctccgtctgttttagttcttcttggtatgcttgatccaagccatagttagacatgactgccaaatccaaggtttgagcagttgttaaataagcattagctgtcgtctccatgttgggactggttactttgaggcctactaaggctagagatcccaacatcatcaggatcaagatggataaaaaacgccccttggagcctgtgaaggactgaattaagtccttccaataagtttttcgcttgatcatgctagtactccaaactgtcaatatcctgaggatgctggttgagcaccacatccttgacactggcatcgtgcatatgaatcacgcgatcagcaatgggcgccaaag

SEQ ID NO: 240 - DNA, 607 bp; single-stranded, linear
ctcaaaaagcagtaaagaaagaagaaaacagtccttttgctggcttacaaggactatttgacggagatgaataatgatcttgtcaaaaaaacgagcacgaaaggtgctagaagaaatcaatgccctattccaagatgccaagcatagtaaaggtaattttaccaatcattaagatactcctgggagcggtaatgtaatcagcccagaagacagatgcaacggtaaataagaccacaccaggtctctttgttgtatatccaacaccccaaaatatgtatgtagcgacagagagagagattgctaaacatatttctcgcttgggatggtatcggaataaagataaattccttaaaaaatgtgcccaacagttagctaaacgattttgatggtcaagtccctcagacacgtgaagaattggagagtttggcaggtgttggtcgcaagacagccaatgttgtcatgagtgtaggatttgggattccagcctttgcagtggatactcatgtggagcgtatttgcaaacaccacgatattgtcgaaaaatcagcgacgccacttgaggtggaaaagcgggtcatggatatcttgccgcctgttcagtggttag

SEQ ID NO: 241 - DNA, 398 bp; single-stranded, linear
ctcatagtattcctctgtttcttctttaatccggataggcagtcaatcctgaaaagacagaggcactcccccttttaaatctttttccttacaattcagcaagaatcgctttaagcaagcctttgaaatcacctttaacacgttcagtcacttctacaacttcttcgtgattgagttcttcttggaaaccagccgcaaagttagtgatacatgaaattcccagaactttcaagccagagtgggctgccacgataacttcaggaaccgtagacataccaactgcatctgctcccagtgtcttatagggaacgaatttctgctggtgtttcataagtcggaccagttaactccgatatagacacctttccatcaaagcttgaatattaagtttttttaga

SEQ ID NO: 242 - DNA, 533 bp; single-stranded, linear
cagttcaactggttgcaaatgcaagagccaaaacccgcaaatccttctgggcagttctaaaatagctgggacactctgcaactggatctgcatcttttctctatccaaatttcaaagcctgctgactgaaacccgataaaatcatgtgggccgcaaacaactcctgactgactgtatcgtgcaaatcccgagcaattcgcttccgttctttctcgatgatttcctcttcatgagcaaggctatgattttcagctttttgaagagcttctgtcaaaaggttaagtttacctgataaggacttgaaactggcatccaaatctggatctgcaacctgaaccacttcttgccctgccaataaacgcttgagattagcctgcatttttcttagagaaagctcttcgatccctcgccaaaacagggctaagagacaggttatggacatgctgaaaaccaacaataaaaagacaaatttttctgttttttcgacatcgtgcaaaaagatagaccagtcaaaatcaagtatttccagcaag

SEQ ID NO: 243 - DNA, 420 bp; single-stranded, linear
ctaccaagagagccagaatacccatagaatagctataaggtttcagtcagaaaggctacaacttgcatcagaccatttaaagccccatgagtttggtacaaaggcaatcaagataaagatacttgagaagagaataacaggcatacctgcaatgaaaccatcacgaatagcacgaagatagatattacgagatagtttttcaaagaaaggctttcctttctcgataaatgcaattagtttattcattatttaactcctctcttgtagagttcaattaaatgatgcatcaaatcttttaacaagatagttgtcattaagtggtcttggccatgcatcatggttacactataagccaagtcctcacctgaagcttccttagtcaatacacttgtttgcgcgtggtgagcctctgcaatacag

SEQ ID NO: 244 - DNA, 513 bp; single-stranded, linear
ctgtctttgaaaaggaaggtaaactgcttgaagcccagcgtttgaaacagcggacagagtatgatatcgaaatgttgcgtgagatgggctataccaatggggttgaaaattattctcgccaacatggatggacggagcgaaggagagcctccttatacgcttctcgacttcttcccagatgatttcttgattatgattgacgagagtcatatgaccatagggcaaatcaagggcatgtacaatggagaccgttcgcgtaaagaaatgctggttaattatggtttccgtttgccgtctgctttggacaatcgtcctctccgtcgggaggagttttgagagttcacgttcatcagattgtttacgttttcagcgacacctggtgacttatgaaaatgaacagaccgagacagtgattgagcaaatcatccgtccaacgggactcttggatccagaggtggaagtccgtccgactatgggacagattgatgacctcttgggtgaaatcaatgcccg

SEQ ID NO: 245 - DNA, 760 bp; single-stranded, linear
tcgcagacaaaccaaggatgatatgaanccattcaatctctatgaagcaagttgaagccaaggaagaagagcaagagcaggctgaacgagaagctgagagtaagaaagaaccttacatctactacatcctttcttttgctaagttggctgacttggtagcttttgccaagacagtgacttttgaaatggaaacttctgaactctacaaaatgaacgagcgctattatggtctctttgaccgattgtagtggactattgtaaatcatccaacggcccatatccagcttggctctgatggcccgaaatgcgcgagtttgcagacgatagtgatatcagtcgctcagtcttacaacagtatggtcaagtcttgatgagtcacgatgcagtgctcaatctgcaaaaatcggctaatcctttctggaaagctntnttnnnattttaanannagcgaatcgtctgatccnttttttctttttntactgatatagtgatttactatnatangaattttcacaannttctgttataatggctatattnaaaantttcgangagataantatnacnnttcanattgctttnctttgatttggttnnnttgcaantggtgtgccttncctccntnnangganaatggaggactantcattnccntccgcncnttcanatacccaanttgctnttgtattngtcccngatcatcatnacttcnctctcttgctcnctccncgggaatgatttttnctttgttcccatcgtt

SEQ ID NO: 246 - DNA, 452 bp; single-stranded, linear
ctggtgaaaaagaattcgcgcttggactttcaaacgtggtatgaaggctcctcaagcagctggtattatccactcagactttgaaaaaggctttattcgtgcagtaaccatgtcatatgaagatctagtgaaatacggatctgaaaaggccgtaaaaaaagctggacgcttgcgtgaagaaggaaaagaatatatcgttcaagatggcgatatcatggaattccgctttaatgtctaaaaattaataaatggtgtcaattaggttggaaaaaaattccaacccttttggcttttgaaaggaaaaataaatgaccaaattacttgtaggcttgggaaatccaggggataaatattttgaaacaaaacacaatgttggttttatgttgattgatcaactagcgaagaaacagaatgtcacttttacacacgataagaatatttccaagaattcg

SEQ ID NO: 247 - DNA, 447 bp; single-stranded, linear
acttttcccacaaccagagggccctaggatgacaacaacttcccttttttgatttctagagaaagtccttggaggatgggattgtctccgaaggatttgtttagttccttgatttctaagatagtttcagacatttagttgctccaatgtttttctaagtgagtggatagtttggaaatagggtagcaaactgcgaaatataagactagaatggttccataaacccaaaatgaaccagttgggatggtcaggcgattgctatcgatgatttgttgtccaactttggtcacttccacaaccccaatcaaaacaactaatgaagtggttttaatcatccgagtgacaagattgatagcctgcggtaccagtcttcttaagacttgtgggatgatgatgtggtactaaagtngaacattagtcaagccgagttgcctgtccacttttcaa

SEQ ID NO: 248 - DNA, 433 bp; single-stranded, linear
ctcgtgctccataagggaaatctcgatggctgacacgcccgtaaaggtcgcatcaaagcgatcttgaaccgactcaggagaggcgccattgtgcaattctaacaaaatatcccgtaggacatgaatccgttcatctgtcattagtctaatccaatcacttcgtagccattcgcttccagtgtgcgtacaatcttgtccataggagttcctgctagcttagaaccctgtttaagtgatactttacgaccaactgtattgcgcattaagggattggcaaggggtttaaaacccaactccactagaatttccaagacttctggatgcttgtccaccacttctgcaacaggaattgacacatcgatgatattgtccatgacgacctccattgtatgttctaatactcaatgaaaatcaaagaaccaactagaacttg

SEQ ID NO: 249 - DNA, 511 bp; single-stranded, linear
cttgtcatgttttagctggaaatttgaaaaaggtagcttctaccatgtatttgttgacaccagtgaatgttattgtaaatgttgaagatatccgtttaccagatgaagatcaacagggtgagttcggttttgatatgaagcgaaatagagtacgataatgatttttttaattcgtatgatttataatgcagtggatatttactccctgattttggtagccttcgctgtcatgtcttggtttccaggtgcctacgaatccagtttaggtcgttggattgtagcgttggtgaaaccagtgcttgctcccttgcaacgcctgcctttacagatagcgggtccttgatttatctatttgggttcgcgaattgttttggttcgatttttaggaaaaaaacctagtatgcgttttcctggcgaatgaataggaatgaataaaggatttatccagcatttctcccatagaagaattcgtccatttccttgacaagggaaatggaatggataaagaagg

SEQ ID NO: 250 - DNA, 588 bp; single-stranded, linear
ctcttcaatacggtcaatcaacttccatgacgcaccaacctcatcccagtggctaaagttagttgagttgttatttaggacatcataaatcaatttctcgtatggttctggagaagcaccagttgcagtcgcgtctgtacgataatcaagtgagttaggagccaagttaaattcttctcctacttgcttcccatttaggctaagagagaagccttctgttggttgaatatagatggtcaaaatatttggagcaagtggttctccaaatatagaatccatttgtttaaagacgatgttgacatgacgttttttcctttttcagtcagtcgtttacctgtacggaaaaagaaaggatctaacaccacggaatcgatcgctgtctacaaagaaggcaccagatgtaaaggtttcagttgttgattctggattcacatttggttcgctacgataagagatgtatttcatgccatcaatcttaccagagcggtattgtccacggataaagtgttctttgagttcttcatcagttggatgatagaagtttttaaagacttaatcttttcagcacaaatctcgtcttttgtgaag

SEQ ID NO: 251 - DNA, 596 bp; single-stranded, linear
ganaacacaaccagagtcagcaataatctccangncatagaaatactccatctttgtcagtcatacatcgacnaaggttctgtctctccnacaattatgtcatgaaaacccttgaaacaaaagcatcatccgtctgtggtgacaagtagaaaggaaaatgtcatgtctgaacgtagaatctctgaaaagtctctcgaaaatctcaaaaaatcaaaccaagaatccnatntattaaccaaagaagccagggacacacgccctcgggcaactattggaaaaaaaggaaatgaccaagattagtatttatgaattggtcaaacgagcaggtgtttcgcgtgcggccttttatcgcaattatgactccaaagaggaaatttcagagagcgtatttaaacgaactgtccacaatattatggaacagatgcatcattacgatttaaagacagacctttatgtggtttgcttcaccttttccgggaggccagaaaggaagctagagtaattcaattggccttggattaccatctggcaaaaatctttgtccaagccatgcaggaatttatagaaaaataccatgggaaatcgaaaggcgtcag

SEQ ID NO: 252 - DNA, 521 bp; single-stranded, linear
cttgtcatgaacatttgaaactgggtcgcttgtgatttgaatctgaagcaaaggcaagtggcaattctgaaccggtccattggtcagaaatgtttgcaccttgctcagtttgagcagatacgcgaacatgaagtttagttgttaattgagtaccttctaagcgaccattaactgtaaagacaccttccttagcgtattgctctggacgaatcgcatcccatgcaaccttagctgatgaaacgtgaccatttgaatcatatgtccgaacactttctggtaattgtggtgcttctgcgattggagttgtcacactgacttcttcaactgaaacgataccgtctacagagacttttgcacgcgcttcaaggtcaattccttcaactttacctagtacttcaaatgtgtgataggagtctactttgtctttcggaatagcttgccaagtgactttatgagttttagggaaacctttgtcatactcaactgttactgttgctggaagacttggttcctgatgcaaa

SEQ ID NO: 253 - DNA, 541 bp; single-stranded, linear
tagaatgatgctctgctagcaggattattcacgctacaggtcaccagagctttcttgatgttcttttccttagcaacttgcaagccctgacggagagttcttttgcataacccttgcctctttcagatggacggatggagtagccaatgtgcccaccttcttctagtagaaagttactgaggcgcaaccggagattaagaaatccaactgcttgacctttctcagaaaaagccactaactgaattgcaggaacccatccttcaggcagattaatccccatttcctgttcctgattgctttccaaccactcttcatacacaaaattctctgtatcccaaaatcctccatcatgggctgattggctcttttcaaactctgtcatcatatctaaaacagctttcttatccgctaatcttggtctgcgtaattccatccttacctcccactatgagaaaagcgagagctggctctcacttttattttttcttgttcttgtttaaaaattgttctctgaagctaagcaagcgttctttcttaccag

SEQ ID NO: 254 - DNA, 486 bp; single-stranded, linear
cctgctccttatctttgcagtaattggcgttttagtggccttgatagctcaattttactcagcaaaggcagcagtaggttttgctaaggaattgacaaacgatctttatcgtcatattctttccttgcccaaggacagcagagaccgtctgacaacttctagtttggttactcgcttgacttcggatacctaccagattcagactggtatcaatcaattcctgctgtctctttttacgagcgcccatatatcgtttttggtgccatttttatggcttatcgaatctcagctgagttgactttctggttcttaatcatggttgccattttgaccattgtcattgttagggttatctcgattggtcaatcctctctacagtagtctcagaaagaaaaccgaaccaactgggttcaggaaaccccccaccaattgcaagggatgccgggttattccgtgcctttggtcaagaaaaacgatagttacagc

SEQ ID NO: 255 - DNA, 581 bp; single-stranded, linear
ctactcaatgacgaccagcagtcataacatcagcaacactaattcccttgccaccttcttgccatccaccttcaagttgatgagcagcaacagcaccaccccataaaaatctatctttaaaagtagtcatcttttttcctcctgactttgatactcttattataaacctcaaaccaaaagatgaaaacgcattctttttccttattgttaaggaaagaagtaatttttaatgggaaatagaacaatatcttcttgtattctcgtaatgatatctttacgattttcaatacttccaaactacaaaaactctcacaataattctaattccctgtgtctataaacgacttatcgctttctggcatcccagaatcatcctctatataacgttcaacttgcatcttggcaagtgatatttttttcttaaatctaagattttctgcattgtctttgattgatgatgcttatctaaagcttcttgatttatccactgatcaataaggagaatagttccctctttttcaattggtaaaaaatattcgtatttcaagttacctttttgatttctaatttcttcaacaagg

SEQ ID NO: 256 - DNA, 417 bp; single-stranded, linear
actcctttgtaattttttacttttcttcttttatgtgtttaagatgatctggatggtcaatctctaaatcaaaaatctctggaatagaactgtagtggataatgcacttgatacccaactgattcattttttgtatgaaagaagtattcagatagcctgctacagcaaaatcaatcttgttctttcttgctttatcctgcatatctcttagcatatctaacattattggactttccatatcatgccattgactgtttctcatagtcgcaaaaacaaaggaagtcaaatcagtcactccaactacaatctttgaaatgcccgtttccagtatactagataagtcaaaatacgctgacggtaattcaatcatcgttccgactttcccagtaaaaccctgctgaggcaatactgtaataa

SEQ ID NO: 257 - DNA, 448 bp; single-stranded, linear
caatccgatccctgaactcactcctgtaatgagaaaacgtttagtcatgcaattctaacccaatccgttgccaaaacatcacaaactgtcgggctccaacatgggaaaaaccttctccttcgccagaaacgttgattaggaaataaggtgtcatttcaagtgcaagcccattttgctcgatggtatcaaagagttggacatagttttccgcacctccccaaccagttcgtacatatttcctcttagcctttaacccaggcaggatctcttcaaatgtcatgttttcctcctttaattctacattcttcatttaattatagcaaaaaaccactttatacggctttttggactgtgagttattcaaacctggctacttacttacgggcaaattattccctgcaggcaagattaaatttcataccattcttttcttgttaagctaaagttt

SEQ ID NO: 258 - DNA, 679 bp; single-stranded, linear
ctacttgtattgctggaaatggtataagatgaaaatctacaagtcactaattttcatataaccaaaaaacgaacaggctctttttctgttattcagaagagaacttgttcgtttttatcttgattttcttaaaaagctctatatacatagggattttctggtttatcgactttggtaaagctgtcgatttccaaggttggaaggttttgtttgagttctttatggtagtgattgaccagttttcctttggctgaaatccaagtgttgttttcatactgccgggtattgcccttggtcagcaatccatagacaccagaatctgcgatgcagtgaataatgccgaagcggaacaaaaattggctattggcatgactggggtcattatagacaaagcctgttgaactggattgtcttaaccctcaaattcatctgggatagtcgtagatagcctccatgacctcccatatagttttcattagtgatctgaatactatcttgggataagtatttatccgccgccgttcgcatttccttttcataggctgattttgaaaaataagaactggtatctggtttcaaatattggcttgtcgtcccttcgcttgtntgaatggctagatccgttccttccgatagggggaaatgataacctttagcagaaacggtctgagaatccaag

SEQ ID NO: 259 - DNA, 521 bp; single-stranded, linear
ctgctatcaagacagtattaccgctgaaagaaacagcttcactaaaaaggcgcaattgaaaaataagacgggatcacgaactcccgtttttctataaaagaaaggaaatgggatgaaaaaattagtctttgtctgtctgggaaatatttgccgtacccctatggccgagtttgttatgaaatcaatgacagataactacgaaatccaaagtcgagcaacttcctcttgggaacatggcaatccgattcataaggggactcagggaatttttcaagagtatgagattccttatgacaagaacaagacatcgcttcagattagtaaggaagattttgaagcctttgattatattatcggaatggacgcttcaaatgtttccgacttacgtcagatgtgtccagtacactgtcaagataagatttactcattttcatctgaaagtgttccagaaccttggtatacagggagattttgaagaaacctatcgacgtgttcaaagaaggctgtcaacttggttagaa

SEQ ID NO: 260 - DNA, 515 bp; single-stranded, linear
ctaaacgaatttccatcttttttcctcatttctgactagtttctcccatcatagcataatttaagtatttctacaagcagttaaaacttgactttgtgtttttgttattttataatctagttatcaaaactatataaaaaggagttgaaaatgaaaactaccttttcctacccaaaatgggcagaaattccaaacattgacctctatctggaccaggttttgctctatgtcaatcaggtctgcgcccctatctctcctaataaagacaagggcctaacagcatctatggtcaacaattatgtgaaaaatggttacctgacaaagcctgacaaaaaaaaataccaacgccaacagattgccccgtttgattgctatcacaaccctcaagttctgtattttcctattccaagaaaatagccccagacacttaatactcctacaaactccaagccaagtttccagaaccaactcctacgaaagcctttgttggaactatatgaacccagaattgaccc

SEQ ID NO: 261 - DNA, 452 bp; single-stranded, linear
cttgttggatacaatctttgaagaaacacaaaagggagatgactaagatgaaacgatggatagcattaaataagatagaatttctattgaccaaacggcaatcagtctattatttattatcagtagggatgccgacagccttctatctattcttttctagcatgtaccaggatactccaggtggacccgcgaattttatgcgtgattatcttatctccatgactgccttttctatgatgtcgacagctatcttctcatttccagttgttttacataccgacaagatgagcaactggcagaaaacattacgtcatagccctgttaatatggtagaatattacctatcaaagataacagtatgctgggttgattatttggttttccattcttggtggtttttcctcagtttgggctttttgttagaaggtgttggacttgttctctaacaaaga

SEQ ID NO: 262 - DNA (cDNA), 571 bp; single-stranded, linear
taactctgctataatggatttattcctttttgtgtttacacaatttattttatactaccaaaaaaacaaggtcaggattttgttcctgacctttgacaactttaccgattctttagttctacatagcgcttgtaccaaatgtttacataggcttctgagaaaggaccacgtccattgttaatccaatcaacaagaattttgacatgttcttttaaaatatagtccaagtcatcagaataattcattttgcgtttgtgacgctcgtactcttcaacgtccaagagacgtttttccccatctgtaaaaattttaacatccaaatcgtaatcaatatacttcagtgcttcttcatccagatagtaggggctagccatattgcaatagtaagaagtccattatcacgaatcatggcaatgatattaaaccaatatttcttgtgaagtaaacaatagccggttctcgagtgaccaacgacgaacatcactttcggtaacaatgtatgatcgttgacccaataatggcgtttctgttgttttaataccattggtgtccgccaagtccgtggaaatcc

SEQ ID NO: 263 - protein, 162 aa
MEKCYTDVTEFAIPASTQKLYLSPVLDGFNSEIIAYNLSTSPNLEQVQTMLEQAFTEKHYENTILHSDQGWQYQHDSYHRFLESKGIQASMSRKGNSQDNGMMESFFGILKSEMFYGYEKSFQSLKQLEQAIIDYIDYYNNKRIKVKLKGLSPVQYRTKSFG

SEQ ID NO: 264 - protein, 46 aa
MIIVGKYDASQILQAVLLQLFWLLVMIALSQIIWKRVQSHITIQGG

SEQ ID NO: 265 - protein, 127 aa
MKIDITNQVKDEFLISLKTLISYPSVLNEGENGTPFGQAIQDVLEKTLEICRDIGFTTYLDPKGYYGYAEIGQGAELLAILCHLDVVPSGDEADWQTPPFEATIKDGWVSDVVSKMIKALRSQLSMQ

SEQ ID NO: 266 - protein, 35 aa
MAEIGAHAQNGERVLTGDELIDFVNNKLFKELKGA

SEQ ID NO: 267 - protein, 280 aa
MWMAAFFGMATKYAEGLLAIKYRTKDDHGAVAGGPMHYILLGMGEKWRPLAVLFAVAGVLVALLGIGTFTQVNSITESIQNTTTISPAITALVLSVFVAIAVFGGLKSISKVSTTVVPFMAIIYILGTLTVIFFNIGKIPGTIALVFTSAFSPLAAVGGFAGASVRMAIQNGVARGVFSNESGLGSAPIAAAAAKTNEPVEQGLISMTGTFIDTLIICTLTGLTILVTGVWSGDLNGVALTQSAFSTVFSHFGPALLTIFLVLFAFTTILGWNYYGRTLF

SEQ ID NO: 268 - protein, 46 aa
MVQVGTTLHKEGVSAFDRFTNELKAIMVEKGYESLEDFRGKLRYID

SEQ ID NO: 269 - protein, 210 aa
MKKYFIGGLGSNAYHSKDFLQELDSQVYFLNPYEKHLRDETELKSWFKNEIVEEESICLIGHSIGGDLARYFASEFEEVKKLILLDGGYLDLDKILPLDTELEETKNYIKSQIISDLDVLTSKEKSEAKHWSENMEKAVRQSYHWNVEYNRYELAINYENIEAILRLRRKIQAFKREVGDTLFISPRYPNEATWREEALKELPDYFDTIF

SEQ ID NO: 270 - protein, 186 aa
MKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGND

SEQ ID NO: 271 - protein, 113 aa
MVMQRLLLKIFPTDNNVVWKLFVPLLRNPKILFLDEPAAGMNPQETAELTELIRRIKDEFKITIMLIEHDMNLVMEVTERIYVLEYGRLIAQGTPDEIKTNKRVIEAYLGGEA

SEQ ID NO: 272 - protein, 82 aa
MTRYALLVRGINVGGKNKVVMAELRQELTNLGLEKVESYINSGNIFFTSIDSKAQLVEKLETFFAVHYPFIPELFFTESRGL

SEQ ID NO: 273 - protein, 110 aa
MEQFLDNIKDLEVTTVVRAQEALDKKETATFFIGRKTCPYCRKFAGTLSGVVAETKAHIYFINSEEPSQLNDLQAFRSRYGIPTVPGFVHITDGTNQRPLADSSMSAQEI

SEQ ID NO: 274 - protein, 191 aa
MYLILPFCVPGSFDRKVLVGRPDVKGREAILKVHAKNKPLAEDVDLKLVAQQTPGFVGADLENVLNEAALVAARRNKSIIDASDIDEAEDRVIAGPSKKDKTVSQKERELVAYHEAGHTIVGLVLSNARVVHKVTIVPRGRAGGYXIALPKEDQMLLSKEDMKEQLAGLMGGRVAEKIISNVQTTRSFKRL

SEQ ID NO: 275 - protein, 84 aa
MKQVFLSTTTEFKEIDTLEPGTWINLVNPTQNESLEIANTFDIDIADLRAPLDAEEMCRITIEDEYTLIIVDVPVTEERNNRTY

SEQ ID NO: 276 - protein, 162 aa
MAQEALQKVAAEMGVGIKVETNGASGVGNQLTAEDIRKAKAIIIAADKAVEMDRFDGKPLINRPVADGIRKTEELINLAISGDAEVYRAANGAKVATASNEKQSLGGAFYKHLMSGVSQMLPFVIGGGIMIALAFLIDGALSVPNENLGNLGSYHEFSFYVP

SEQ ID NO: 277 - protein, 97 aa
MDIWEKMYEEAQKLYNPHEVSDFVYANHVVAAVEAGDGQIFTGFCMEGTCGVFHLCAERAALFNMYQFSGQTKVXEVLAFRDKPPYGGSSAMPLRCL

SEQ ID NO: 278 - protein, 146 aa
LYLVATPIGNLDDMTFRAIQTLKEVDWIAAEDTRNTGLLLKHFDISTKQISFHEHNAKEKTPDLIGFLKAGQSIAQVSDAGLPSISDPGHGFGLRQLLEGRNCSCYSSRCLCRNFCLDCQWFSATATYLLRFFTEKIRSTEAIFWL

SEQ ID NO: 279 - protein, 74 aa
MPDNLALRMRPKTIDQVIGQEXLVGPGKIIRRMVEANRLSSMILYGPPGIGKTSIASAIAGTTKYALRDPQRDS

SEQ ID NO: 280 - protein, 44 aa
MQDEVEVGDVFKDVYNALNEEGVFIFDVHSTYQTDEVLPWLFLP

SEQ ID NO: 281 - protein, 79 aa
LSLIDNDPFKDDEDFVSTYDLDKSFISMVSVDVSEYLGSQEPIKKTLTIPKWADKLGREMGLNFSQTLTDAIADKKVQA

SEQ ID NO: 282 - protein, 220 aa
LTKSMTPDREVITFIPEKFIVDGFQGIRDPRGMMGVRLEMRGLLYTGPRTILHNLRKTVERAGVQVENVIISPLAMVQSVLNEGEREFGATVIDMGAGQTTVATIRNQELQFTHILQEGGDYVTKDISKVLKTSRKLAEGLKLNYGEAYPPLASKETFQVKVIGEVEPVKVTEAYLSEIISARIKHILEQIKQELDRRRLVGPPWWYCLNRWECHFTRYG

SEQ ID NO: 283 - protein, 96 aa
MMPEWRLDLIKEYYVPYMSNDNNYPRVFMTQEDLDKIAHIEADMNDYIYRKRAEWIVNGNIDTEWDDYKKELEKYGLSDYLAIKQKYYDQYQANKN

SEQ ID NO: 284 - protein, 161 aa
MRIAIGCDHFVTDEKMAVSEFLKSKGYEVIDFGTYDHTRTHYPIFGKKVREAVTIGQPDLGVCTCGTGVGINNPVNKVPRVRSALVRDMTTALYAKEQLNANVIGFGGKITGELLMCDIIEAFIHAEYKPSEENKKLIAKIEHVETHNAQQTDANFFTEXP

SEQ ID NO: 285 - protein, 77 aa
LKKQVLTMXIDRRPFGGADIDAAGPPLPDETLKASREADAILLVAIGSPQYDGVAVRPEQGLMALRKNSIFTLIFVL

SEQ ID NO: 286 - protein, 59 aa
MAFIEKGQEIDMEVIKAETQLSAEALRLKESRDRELADIISGEDDRILLVIGPCSSDND

SEQ ID NO: 287 - protein, 56 aa
MVMRVYTAKPRTNGDGYKGLVHQPDTSKAPTLINGLQAVRHLHYRFDYRYWFDNGR

SEQ ID NO: 288 - protein, 63 aa
MNKRVKIVATLGPAVEIRGGKKFGEDGYWGEKLDVEASAKNIAKLIEAGANTFRFNFSHGDHQ

SEQ ID NO: 289 - protein, 52 aa
MGDKPISFRDADGNFVSAADVWNEKKLEELFNRLNPNRALRLARTKKENPSQ

SEQ ID NO: 290 - protein, 55 aa
MIVTNVSDSQLLSQILLNLLSNAIRYTEQGGKIEVKTQKVNEGIKISVSDTGHWY

SEQ ID NO: 291 - protein, 80 aa
LNIGLEGVYQQENAALALQTFLLFMGEGXEAVDEQAVRKALEHTHWAGRLERIRPQIYLDGAHNLPALTRLVDFIXQXXS

SEQ ID NO: 292 - protein, 122 aa
MSRIGNKVIVLPAGVELANNDNVVTVKGPKGELTREFSKDIEIRVEGTEITFHRPNDSKEMKTIHGTTRALLNNMVVGVSEGFKKELEMRGVGYRAQLQGSKLVLAVGKSHPDEVEAVRNYF

SEQ ID NO: 293 - protein, 174 aa
MAQDIKNGEVEEVQEEEVVETAEETTPEKSELDLANERADEFENKYLRAHAEMQNIQRRANEERQNLQRYRSQDLAKAILPSLDNLERALAVEGLTDDVKKGLGMVQESLIHALKEEGIEEIAADGEFDHNYHMAIQTLPADDDHPVDTIAQVFQKGYKLHDRILRPAMVVVYN

SEQ ID NO: 294 - protein, 41 aa
MSAYLKEAFKGAAKTQTKTNFGKPYFHIEKYKQDSLVTYRN

SEQ ID NO: 295 - protein, 84 aa
MVAREAKRQKIVDRYAEKRAALKAAGDYEGLSKLPRNASPTRLHNRCRVTGRPHSVYRKFGLSRIAFRELAHKGQIPGVTKASW

SEQ ID NO: 296 - protein, 208 aa
MTKGILGKKVGMTQIFTEAGELIPVTVIEATPNVVLQVKTVETDGYNAIQVGFDDKREVLSNKPAKGHVAKANTAPKRFIREFKNVEGLEVGAEITVETFAAGDVVDVTGTSKGKGFQGVIKRHGQSRGPMAHGSRYHRRPGSMGPVAPNRVFKGKNLAGRMGGDRVTIQNLEVVQVVPEKNVILIKGNVPGAKKSLITIKSAVKAGK

SEQ ID NO: 297 - protein, 216 aa
MRNQFDLELHELEQSFLGLGQLVLETASKALLALASKDKEMAKLIINKDHAINQGQSAIELTCARLLALQQPQVSDLRFVISIMSSCSDLERMGDHMAGIAKAVLQLKENQLAPGEEQLHQMGKLSLSMLADLLVAFPLHQASKAISIAQKDEQIDQYYYALSKEIIGLMKDQETSIPNGTQYLYIIGHLERFADYIANICERLVYLETGELVDLN

SEQ ID NO: 298 - protein, 151 aa
MISTWMVRQRIPLQKVFVTVTMPTVGILPWLKMEQTWKPSMLLSKQQKFQASRCLIEVKTVIGYGSPNKSGTNAVHGAPLGAEETGATRKFLGWDYDPFEVPEEVYSDFKTNVADRGQEAYDAWASLVSDYKVAYPEVASEIDAIVLENPL

SEQ ID NO: 299 - protein, 253 aa
LGAILLSFRLIPQLGWGRGLFSSIFLAISAFCNAGFDNLGSTSLFAFQTDLLVNLVIAGLIITGGLGFMVWFDLAGHVGRKKKGRLHFHTKLVLLLTIGLLLFGTATTLFLEWNNAGTIGNLPVADKVLVSFFQTVTMRTAGFSTIDYTQAHPVTLLIYILQMFLGGAPGGTAGGLKITTFFVLLVFAQSELLGLPHANVARRTIAPRTVQKSFSVFIIFLMSFLDRIDSARDNSQRQSSLYPPPYLKPFPAP

SEQ ID NO: 300 - protein, 247 aa
MQQYFVKGSAISPVTIEDKETSKHMFQVMRLKEEDEVTLVFDDGIKRLARVLDMENRQFELVQELNDNVELPVQVTIASGFPKGDKLEFIAQKVTELGASQIWAFPADWSVAKWDGKKLGKKVEKLEKIALGAAEQSKRNIVPSIKLFEKKADFLAQLDQFDSIIVAYEESAKEGEAAALLQAVTGLETGAKLLFIFGPEGGLSPAEIESFEAKGAVLAGLGSRILRAETAPLYALSALSVLVELEK

SEQ ID NO: 301 - protein, 671 aa
MKKLFILISNLLASLFFVWVFTIWTDTYVSYYYPNVVVHDSSPETTFQHVATRLEKLAEETDSFIAIQHQDPNSEGTTVFSYTTFGDGKLPDGLQEKKLEDAQSSSVETNYFVFDGHLDIHLLREELSQLGLTNMNLTIPSKLSTLMAIFSNGFQLISLLIFILTFVALTLISQISQLRSSGIRLISGEKRWSIFLRPVGEDLKGIAVGFSLAGVLAILMQKILSLPTQSLMTIGAGLLSYNLILLSISLFFAQLFAVGIKKIHLMQIIKGQVPVRGIISLILIGQLLAIIIVTLGIGSSLKYSQAWQQHRIGQEVWSQERQLITLSISREGTSPGFDEQAQRKLRTWYQLMDLAVSEQKAFLSRHQLIDRTLQNGMASSKNLITSTEWHDYNPNGNVLIVTPQYLERQNIPVDTTIEQKMNHLDVGEFVLLLPEHLRSEEEHYKSVFEDDLTSRMSSQDERQQMTATVGYLESGQDRFVYNTTPISYQQFLKDPIIIVITPQSTGPQSILFWIDAVQNYVLFNQLSDAQELIQRQGIENWVSEMQTGYHNYITLLDNIQRERWVMLAGAVLGIATSILLFNTMNRLYFEEFRRAIFIKRIAGLRFLEIHRTYLFAQLGVFLLGFVASVFLQVEIGVAFLVLLLFTGLSLLQLHVQMQKENKMSILVLKGG

SEQ ID NO: 302 - protein, 77 aa
MKEKEIFDSIVTIIQERQGEDFVVTESLSLKDDLDADSVDLMEFILTLEDEFSIEISDEEIDQLQSVGDVVKIIQGK

SEQ ID NO: 303 - protein, 96 aa
MRSDFLRNKIWYSSSMNDEASKQLTDARFKRLVGVQRTTFEEMLAVLKTAYQLKHAKGGRKPKLSLEDLLMATLQYVREYRTYEEIAADFGIHEST

SEQ ID NO: 304 - protein, 104 aa
MKLFKMSCRNIGQAGKILADSDYQGLMKIYPQAQTPRKSSKLKPLTAEDKAYNHALSKERSKVENIFAKVKTFKMFSTTYRNHRKRFGLRMNLIAGIINHELGF

SEQ ID NO: 305 - protein, 79 aa
LRKVVVVRLEKPVTFHNMIAPDKEVEVSLLFFIINNSSSSQTNILAQLMDFFTGNGHLEDLSKISEPEKLYAYIAEATA

SEQ ID NO: 306 - protein, 100 aa
MIKILAACGAGVNSSHQIKSALEEELSNRGYDVHCDAVMVKDVNEDLMKGYDIFTPIAATDLGFEPGIPVIEAGPILFRIPAMSAPVFDNIRLPAKQNMV

SEQ ID NO: 307 - protein, 62 aa
MVVSFILLMATIVVEPLEGIFHVTKLDLSQWGIVMAGSFSMIIIVEIAKFIQRKLGFDKNAI

SEQ ID NO: 308 - protein, 158 aa
MNHKPRGRKASFFSGGVLSSIIYQGVLQAALVMSVYGLAIAYPVHVGDNHAIHADALTMAFATLGLIQLFHAYNVKSVYQSILTVGPFKSKTFNWSILVSFILLMATIVVEPLEGIFHVTKLDLSQWGIVMAGSFSMIIIVEIVKFIQRKLGFDKNAI

SEQ ID NO: 309 - protein, 249 aa
MAHQALRVLAGAYKIIDSIPENLTSEELENDLIFTGLIGMIDPERPEAAEAVRVAKEAGIRPIMITGDHQDTAEAIAKRLGIIDANDTEGHVLTGAELNELSDEEFEKVVGQYSVYARVSPEHKVRIVKAWQKQGKVVAMTGDGVNDAPALKTADIGIGMGITGTEVSKGASDMILADDNFATIIVAVEEGRKVFSNIQKTIQYLLSANTAEVLTIFLSTLFGWDVLQPVHLLWINLVTDTFPAIVLWC

SEQ ID NO: 310 - protein, 498 aa
MKQSKMPIPTLREMPSDAQVISHALMLRAGYVRQVSAGVYSYLPLANRVIEKAKNIMRQEFEKIGAVEMLAPALLSAELWRESGRYETYGEDLYKLKNREKSDFILGPTHEETFTAIVRDSVKSYKQLPLNLYQIQPKYRDEKRPRNGLLRTREFIMKDAYSFHANYDSLDSVYDEYKAAYERIFTRSGLDFKAIIGDGGAMGGKDSQEFMAITSARTDLDRWVVLDKSVASFDEIPAEVQEEIKAELLKWIVSGEDTIAYSSESSYAANLEMATNEYKPSNRVVAEEEVTRVETPDVKSIDEVAAFLNVPEEQTIKTLFYIADGELVAALLVGNDQLNEVKLKNHLGANFFDVASEEEVANVVQAGFGSLGPVGLPENIKIIADRKVQDVRNAVVGANEDGYHLTGVNPGRDFTAEYVDIREVREGEISPDGQGVLNFARGIEIGHIFKLGTRYSASMGADVLDENGRAVPIIMGCYGIGVSRLLSAVMEQHARLFV

SEQ ID NO: 311 - protein, 44 aa
MGIIRIGAEVKEGDILVGKVTPKGEKDLSAGRTSLARYLWRQVS

SEQ ID NO: 312 - protein, 66 aa
MRVLDEDDQEVELRDLDEGMDEDVIHVDDLEKAREKAAQEAKAAFEAEEAEKATKAEATEEAAEQE

SEQ ID NO: 313 - protein, 364 aa
MLVNVVPLPSQPTWRVVVPTSSLVKVFVNLEDFVLLVPERHESRRIDNQLRGRSGRQGDPGESQFYLSLEDDLMKRFGSERLKGIFERLNMSEEAIESRMLTRQVEAAQKRVEGNNYDTRKQVLQYDDVMREQREIIYAQRYDVITADRDLAPEIQSMIKRTIERVVDGHARAKQDEKLEAILNFAKYNLLPEDSITMEDLSGLSDKAIKEELFQRALKVYDSQVSKLRDEEAVKEFQKVLILRVVDNKWTDHIDALDQLRNAVGLRGYAQNNPVVEYQAEGFRMFNDMIGSIEFDVTRLMMKAQIHEQERPQAERHISTTATRNIAAHQASMLEDLDLSQIGRNELCPCGSGKKFKNCHGKRQ

SEQ ID NO: 314 - protein, 128 aa
MARQYKVDGIPAGIVSLSSFITVTPFITGEAGAGMPTAFMASKGLFVAMILGLINGYIYQWFINHNIQIKMPDGVPPAVSKSFSAIIPGAVTIVGWLIVYATLDKLSLPNLHEIAQVSFGRSTWTFRK

SEQ ID NO: 315 - protein, 203 aa
MLELRNINKVFGDKQILSDFSLSIPEKQILAIVGPSGGSKTTLLRMLAGLETIDSGQIFYNGQPLELDELQKRNLLGFVFQDFQLFPHLSVLENLTLSPVKTMGMKQEEAEKKASGLLEQLGLGGHAESYPFSLSGGQKQRVALARAMMIDPEIIGYDEPTSALDPELRLEVEKLILQNRELGMTQIVVTHDLQFAENIAMYY

SEQ ID NO: 316 - protein, 57 aa
MTALFLVACGKNSSETSGDNWSKYQSNKSITIGFDSTFSSQWDLLRKMVLMQDLILI

SEQ ID NO: 317 - protein, 181 aa
MTQAILEIKHLKKSYGQNEVLKDISLTVHKGEVISIIGSSGSGKSTFLRSINLLETPTDGQILYHGQNVLEKGYDLTQYREKLGMVFQSFNLFENLNVLENTIVAQTTVLKRERTEAEEIAKENLEKVGMGERYWQLPNQIATIRWSKTTCGHRSCPINESRHLCSLMNQLLPLTLRWLEK

SEQ ID NO: 318 - protein, 85 aa
MLFDEPTSALDPEMVGEVINVMKELAEQGMTMIIVTHEMGFARQVANRVIFTADGEFLEDGTPDQIFDNPQHPRLKEFLDKVLNV

SEQ ID NO: 319 - protein, 332 aa
MAKDILVQAMQRIAGEYVAESTNSTVHLPDDTMKGRIIGREGRNIRTFESLTGVDVIIDDTPEVVTLSGFDPIRREIARMTMEMLLKDGRIHPARIEELVEKNRQEIDNKIREYGEAAAYEIGAPNLHPDLMKIMGRLQFRTSYGQNVLRHSIEVAKLAGIMASELGENAALARRAGFLHDIGKAIDHEVEGSHVEIGMELARKYKEPPVVVNTIASHHGDVEAESVIAVIVAAADALSAARPGARSESLESYIKRLHDLEEIANGFEGVQTSFALQAGREIRIMVNPGKIKDDKVTILAHKVRKKIENNLDYPGNIKVTVIRELRAVDYAK

SEQ ID NO: 320 - protein, 123 aa
MKSSQEAAELMLLNAEQEATNLRGQAEREADLLVNEAKRESKSLKKEALLEAKEEARKYREEVDAEFKSERQELKQIESRLTERATSLDRKDDNLTSKEQTLEQKRTKYFLIERKTLMRVKSN

SEQ ID NO: 321 - protein, 122 aa
MYDFKGKKFLQILIIIASMSTPFVGAYSWILLLGRNEVITKFLTNALYLPAIDIYGFKGIILVFTLQLFPLVFLYVAGTMNSIDNSLLEAAESMGSFGFKPIVTVVLPLLVPTLLAAPCLYL

SEQ ID NO: 322 - protein, 160 aa
MRAFSDFGTPMLIGEGYRTFPVLIYTQFISEVGGNSAFAIMAIIIALAIFLIQKHIANRYSFSMNLLHPIEPKKTTKGKMAAIYATVYGIIFISVLPQIYLIYTSFLKTSGMVFVKGYSPNSYKVAFNRMGSAIFNTIRIPLIALVLVVPIYDIYLLPSR

SEQ ID NO: 323 - protein, 146 aa
MESNSSLTLLKHGSEVNLERALSVNGRLGGHVVTGHIDGTGKISSIKKDDNAVWYQINTQKEILDLIVEKGSITIDGISLTVAKVSKVNFSVSVIPHTLKQTILKSKQVGSTVNLENDILGKYVQKLMDNSPKSEISKELLYQNGF

SEQ ID NO: 324 - protein, 288 aa
MSRQTPSLSFEVFPPNPAVGNDNIISALQDMQELAPHFISVTASNNKFNIKETTVRLADFIQNDLAIPTIAHLPAIYLTKDKVAETIADLDKVGVQKILALRGDIIPDVEPQKDFRYATDLIEFIKEQTPHFDIIGACYPEGHPDSPNQISDIQNLKKKVDAGCSSLVTQLFFDNERFYDFQDKCILAGIDVPIHAGIMPILNRNQALRLLKTCENIHLPRKFKAILDKYEHDPESLRAAGLAYAVDQIVDLVTQDVAGVHLYTMNNADTAKYIHQATHALFNHQSLG

SEQ ID NO: 325 - protein, 252 aa
LEELALWFEKLHDFPQLQGNLQAFNDAGFIENFASEELARIRRKIHDSESQVRDVLQDLLKQKAQMLTEGIVASRNGRQVLPVKNTYRNKIAGVVHDISASGNTVYIEPREVVKLSEEIASLRADERYEMLRILQEISERVRPHAAEIANDAWIIGHLDLIRAKVRFIQERQAVVPQLSENQEIQLLHVCHPLVKNAVANDVYFGQDLTGYCHYRSQYRWEDHHAQNSGLDTGHGPVRIADFSRQGKSCWYF

SEQ ID NO: 326 - protein, 106 aa
MGAYYLVMQSLSYLEYEQGIQSTTVRHLILVFYLLFFMGGIKKLDTYLKEKLQEELNQEQTLRYRDMERYSRHIEELYKEIRSFRHDYTNLLTSYVWALKRRIWSR

SEQ ID NO: 327 - protein, 108 aa
MSLLDFLTIVSILCDNAIKASAEASQPHVSIAFLKNGAQETFIIENSIKEEGIDISEIFSFGASSKGEERGVGLYTVMKIVESHPNTNLNTTCQNQVFRQVLTVIHAE

SEQ ID NO: 328 - protein, 104 aa
LISLGNLKMNHSSHEVQIGEKMLDLTVKSFELLWILASNPERVFSKTDLYEKIWKEDYVDDTNTLNVHIHALRQELAKYSSDQTPTIKTVWGLGYKIEKPRGQT

SEQ ID NO: 329 - protein, 59 aa
MAQTSKTTVSFYLNGKYEKMSQETREKIEKVIHETNYKPSIVARSLKLQTNKINRCFDR

SEQ ID NO: 330 - protein, 186 aa
MHYIEGAYWSAEPDLPYLHKRKILMLVEDVWLLVDDIRCQGQHEALTQFILDKDVTYQDGKINQLRLWSEVDFDLEDTIISPKYNELERSSKLTKRQFFENQMLDYTIIAHESFEIIRHSVYQTDDREVENALAFEVKNDETDKLILLLSEDIGVGEKLCLVDGTKMRGKCLVYDKINERMIRLQC

SEQ ID NO: 331 - protein, 286 aa
MNCEAVALGSFCELKSRRGKKQKGEILMAVISMKQLLEAGVHFGHQTRRWNPKMAKYIFTERNGIHVIDLQQTVKYADQAYXFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAAPETQADSIEEIVEVVEGDNA

SEQ ID NO: 332 - protein, 202 aa
MKQLISLKNIFRSYRNGDQELQVLKNINLEVNEGEFVAIMGPSGSGKSTLMNTIGMLDTPTSGEYYLEGQEVAGLGEKQLAKVRNQQIGFVFQQFFLLSKLNALQNVKLPLIYAGVSSSKRRKLAEEYLDKVELIERSHHLPSELSGGQKQRVAIARALVNNPSIILADEPTGALDTKTGNQIMQLLVDLNKERKNHYHGNA

SEQ ID NO: 333 - protein, 164 aa
MTSVIKWTLRKLFQSQPFRGNNVSRLVDILSENLDEGFQYFPSDQITDHPERFLVSEMVREKVLHLTREEIPHSVAVVVDSMKRDEETDKVHIRATIMVERDSQKGIIIGKGGAMLKKIGSMARRDIELMLGDKVFLETWVKVKKNWRDKKLDLADLGYNEREY

SEQ ID NO: 334 - protein, 156 aa
MTFKSGFVAILGRPNVGKSTFLNHVMGQKIAIMSDKAQTTRNKIMGIYTTDKEQIVFIDTPGIHKPKTALGDFMVESAYSTLREVDTVLFMVPADESRGKGDDMIIERLKAAKVPVILVVNKIDKVHPDQLLSQIDDFRNQMDFKEIVPISALQGK

SEQ ID NO: 335 - protein, 152 aa
MTEIRLEHVSYAYGQERILEDINLQVTSGEVVSILGPSGVGKTTLFNLIAGILEVQSGRIVLDGEENPKGHVSYMLQKDLLLEHKTVLGNIILPLLIQKVDKAEAISRADKILATFQLTAVRDKYPHELSGGMRQRVALLRTYLFGHKNRNP

SEQ ID NO: 336 - protein, 81 aa
MTKMELHAWYLEIHKQLQLTTLIXTHSIEEALXLSDRIYILXNXPGQIVSEIKLDWSEDEDXEVXKIAXKRQILAELGLDK

SEQ ID NO: 337 - protein, 266 aa
MRCKMLDPIAIQLGPLAIRWYALCIVTGLILAVYLTMKEAPRKKIIPDDILDFILVAFPLAILGARLYYVIFRFDYYSQNLGEIFAIWNGGLAIYGGLITGALVLYIFADRKLINTWDFLDIAAPSVMIAQSLGRWGNFFNQEAYGATVDNLDYLPGFIRDQMYIEGSYRQPTFLYESLWNLLGFALILIFRRKWKSLRRGHITAFYLIWYGFGRMVIEGMRTDSLMFFGLRVSQWLSVVFIGLGIMIVIYQNRKKAPYYITEEEN

SEQ ID NO: 338 - protein, 243 aa
MSKIIDRYRPAGEGFVRIDTQNNMPTAAGLSSSSSGLSALVKACNAYFKLGLDRSQLAQEAKFASGSSSRSFYGPLGAWDKDSGEIYPVETDLKLAMIMLVLEDKKKPISSRDGMKLCVETSTTFDDWVRQSEKDYQDMLIYLKENDFAKIGELTEKNALAMHATTKTASPAFSYLTDASYEAMAFVRQLREKGEACYFTMDAGPNVKVFCQEKDLEHLSEIFGQRYRLIVSKTKDLSQDDCC

SEQ ID NO: 339 - protein, 191 aa
MHNGFVNIDNVKMSKSLGNFITVHDALKTLDGQVLRFFFATQHYRKPINFTEKAVRDAETNLKYLKNTYEQPFTGNVDAQELQNFKDKFVAAMDEDFNAANGITVVFEMAKWINSGNYDASVKQALADMLEIFGIVFVEEVLDAEIEDLIQKRQEARANRDFETADQIRDQLVTQGIKLLDTKDGVRWTRD

SEQ ID NO: 340 - protein, 248 aa
MKRTGLFTKIFIYTFSIFSVLVICLHLAIYFLFPSTYLSHRQETIGQKATAIAQSLEGKDRQSIEQVLDLYSQTSDIKGTVKGEMTEDKLEVKDSLPLDTDRQTTSLFIEEREVKTQDGGTMILQFLASMDLQKEAEQISLQFLPYTLLASFLISLLVAYIYARTIVAPILEIKRVTRRMMDLDSQVRLRVDSKDEIGNLKEQINSLYQHLLTVIADLHEKNEAILQLEKMKVEFLQGASHELKHTAG

SEQ ID NO: 341 - protein, 239 aa
LLESYSREQVNFFVDQGAVTIVQKEVRRSAAYFEGIEASRPLELNPEQRQARDAVVSSIGSSQPPFLLQGITGSGKTEVYLQIIQGALDKGKTAILLVPEISLTPQMTERFIARFGDKVAILHSGLSNGEKYDEWRKVERGDAQVVVGARSAIFAPLKNLGVMIIDEEHEAAYKQDSNPRYHAREVAILRARYNQATLVLGSATPSLESRARAGKGVYQHLRLTQRANPLATIPEVSSD

SEQ ID NO: 342 - protein, 94 aa
MCMVMQLLGHQLVLIGFKGSRKCTPFAAQMASEAAAKSAQEHGLKSVEVTVKGPGSGRESAIRALAAAGLEVTAIRDVTPVPHNGARPPKRRRV

SEQ ID NO: 343 - protein, 61 aa
MISLPENLFANAKQSKTIFILQKKSEIAVEPFVYPLASLQDASVLMKFKENFQKWTQGTEI

SEQ ID NO: 344 - protein, 401 aa
MGKFRQSQPSVSNNGLATVVPSVREGEPVRVIAKAENGDILGEYRLHFTKDKNLLSHKPVAAVKQARLLQVGQALELPTKVPVYFTGKDGYETKDLSVEWEEVPAENLTKAGQFTVRGHVLGSDLVAEVTVRVTDKLGEALSDNPNYDENSNQAFASATNDIDKNSHDRVDYLNDGDHSENRRWTNWSPTPSSNPEVSAGVIFRENGKIVERTVAQAKLHFFADSGTDAPTKLVLERYVGPEFEVPTYYSNYQAYDADHPFNNPENWEAVPYRADKDIAAGDEINVTFKAVKAKAMRWRMERKADKSGVAMIEMTFLAPSELPQESTQSKILVDGKELADFAENRQDYQITYKGQRPKVSVEENNQVASTVVDSGEDCLPVLVRLVSESGKQVKEYRYPVD

SEQ ID NO: 345 - protein, 207 aa
MNIQEEIKKRRTFAIISHPDAGKTTITEQLLYFGGEIREAGTVKGKKTGTFAKSDWMDIEKQRGISVTSSVMQFDYDGKRVNILDTPGHEDFSEDTYRTLMAVDAAVMVVDSAKGIEAQTKKLFEVVKHRGIPVFTFMNKLDRDGREPLDLLQELEEILGIASYPMNWPIGMGKAFEGLYDLYNQRLELYKGDERFASPRRWRQTFW

SEQ ID NO: 346 - protein, 284 aa
MLINSLNQSYISAKRIEEVFAESPENIHSELEQKQVTSGRVLQVQELTFTYPDAAQPSLRDISFDMTQGQILGIIGGTGSGKSSLVQLLLGLYPVDKGNIDLYQNGRSPLNLEQWRSWIAYVPQKVKLFKGTIRSNLTLGLNQEVSDQKLWQALEIAQAKDFVSEKEGLLDALIEAGGRNFSGGQKQRLSIARAVLRQAPFIILDDATSALDTITESKLLKAIRENFPNTSLILISQRTSTLQMADQILLLEKGELLAVGKHDDLMKSSQVYREINASQHGKED

SEQ ID NO: 347 - protein, 57 aa
MIDDAGVGVKILTSSKDANDLLEKKIDGLIEKFKHAYANVKIEKLETINSKEIERKW

SEQ ID NO: 348 - protein, 43 aa
MTGAGFGGCAIALVQKDTVEAFKEAVGKLYKEVVGYPXSLLYR

SEQ ID NO: 349 - protein, 60 aa
MAQHLTTEALRKDFLAVFGQEADQTFFSPGRINLIGEHTDYNGGHVFTWCYFLGNLRCSS

SEQ ID NO: 350 - protein, 282 aa
MTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALSSNPAAPGSH

SEQ ID NO: 351 - protein, 71 aa
MMIALDVVLTPIFRIEGMAPMSSVVNILAGIMMGPVYALAMATVTAFIRMTTQGYSDKLLYLSQERLLEPF

SEQ ID NO: 352 - protein, 103 aa
MTANEWIWDKESWFYLKSDGKIAEKEWVYDSHSQAWYYFKSGGYMAKNETVDGYQLESDGKWLGGKATNENAAYYQVVPVTANVYDSDGGKAFPIYRKVVSYG

SEQ ID NO: 353 - protein, 167 aa
LDHTIFCVGYRVMQKDLEGTLDAEKLKAAGVPFGPLFGKIKNGQDLVLEDGTEIKAADYISAPRPGKIITILGDTRKTDASVRLAVNADVLVHESTYGKGDEKIARNHGHSTNMQAAQVAVEAGAKRLLLNHISARFLSKDISKLKKDAATIFENVHVVKDLEEVEI

SEQ ID NO: 354 - protein, 251 aa
MPTILITGASGGLAQEMVKLLPNDQLILLGRNKEKLAQLYGNYSHAELIEIDITDDSALEALVTDLYLRYGKIDVLINNAGYGIFEGFDQIADKDIHQMFEVNTFALMNLSRHLAARMKESSKGHIINIVSMAGLIATGKSSLYSATKFAAIGFSNALRLELMPYGVYVTTVNPGPIRTGFFDQADPDGTYLKSVDRFLLEADAVAKKIVKIIGKNKRELNLPILLNLAHKFYTLFPKLADKLAGETFNYK

SEQ ID NO: 355 - protein, 114 aa
MSCLVWDQSQQKNNAKLGIENLQDLLLYFPFRYEDFKTKQVLELEDGEKAVLSGQVVTPASVQYYGFKRNRLRFSLKQGEVVFAVNFFNQPYLADKIELGATLAVFGKWDRAKG

SEQ ID NO: 356 - protein, 363 aa
MKVLAQVEDDLQPVYRLAQGISQASLVKVIKTAFDQGLDLLIEENLPQSLLDKYKLMSRCQAVRAMHFPKDLAENKQALRRIKFEELFYFQMQLQTLKSENRVQGSGLVLDWSQEKVTAVKASLPFALTQAQEKSLQEILTDMKSDHHMNRLLQGDVGSGKTVVAGLAMFAAVTAGYQAALMVPTEILAEQHFESLQNLFPNLKLALLTGSLKAAEKREVLETIAKGEADLIIGTHALIQDGVEYARLGLIIIDEQHRFGVGQRRILREKGDNPDVLMMTATPIPRTLAITAFGDMDVSIIDQMPAGRKPIVTRWIKHEQLPQVLTWLEGEIQKGSQVYVISPLIEESQAPRFEKMPLPYQRS

SEQ ID NO: 357 - protein, 202 aa
MKDLVQKLASKEELSTADNEMIELLARFNERQASFFGQFSVRGYVNYDKHVAKYLKILPDQFSYQAIEDVVKADAEKNTSNNEMGMENYFYNEQIKKDLKKLKDSQKSFTYLKSPEYNDLQLVLTQFSKSKVNPIFIIPPVNKKWMDYAGLREDMYQQTVQKIRYQLESQGFTNIANFSKDGGEPFFMKDTIHLGWLGLVGF

SEQ ID NO: 358 - protein, 112 aa
MKQLSSAQVRQMWLDFWATKGHSVEPSVSLVPVNDPTLLWINSGVATLKKYFDGTIIPENPRITNAQKAIRTNDIENVRERLRVTIPCLKCWGTSLSGITSVTKLSLGLMSF

SEQ ID NO: 359 - protein, 110 aa
MIALGWSNIGAAIAPDAALASVAAAIIMVLGGDFTKTGIGVAQAVAIPLAVAGLFLTMIVRTISVGLVHTADAAAKKGDFGAVERAHFIALLFQGLRIALPAALLPYGTN

SEQ ID NO: 360 - protein, 141 aa
MLPLKKVTSALWSVRISLRYFSKDFVSRFLQLFSLMVPTETVQSILSAMPDWLKDGMAIGGGMVVAVGYAMVINMMATREVWPFFALGFVLAAVSDITLIGFGAIGVAIALIYLHLSKTGGNGGGGAATSNDPIGDILEDY

SEQ ID NO: 361 - protein, 86 aa
MAKNGVDGVYNADPKKDKTAVKFEELTHRDVINKGLRIMDSTASTLSMDNDIDLVVFNMNQSGNIKRVVFGENIGTTVSNNIEEKE

SEQ ID NO: 362 - protein, 50 aa
LINLYPDLDFIVTTVALQEPASVPFVLVSAFLTEGDKQRLQAKIQEINYE

SEQ ID NO: 363 - protein, 175 aa
MSYFKKYKFDKSQFKLGMRTFKTGIAVFLVLLIFGFFGWKGLQIGALTAVFSLRESFDESVHFGTSRILGNSIGGLYALVFFLLNTFFHEAFWVTLVVVPICTMLTIMTNVAMNNKAGVIGGVAAMLIITLSIPSGETILYVFVRVLETFMGVFVAIIVNYNIDRIRLFLEKKEK

SEQ ID NO: 364 - protein, 69 aa
MIAKEFETFLLGQEETFLTPVKNLVVLIDTHNADHATLLLSQMTYTRVPVVTDEIQLRWRQDVLYQQVL

SEQ ID NO: 365 - protein, 173 aa
MAKQTIIVMSDSHGDSLIVEEVRDRYVGKVDAVFHNGDSELRPDSPLWEGIRVVKGNMDFYAGYPERLVTELGSTKIIQTHGHLFDINFNFQKLDYWAQEEEAAICLYGHLHVPSAWLEGKILFLNPGSISQPRGTIRECLYARVEIDDSYFKVDFLTRDHEVYPGLSKEFSR

SEQ ID NO: 366 - protein, 456 aa
MSTTIIGFPRLGEFRELKFTTEKYFRKEISEEELLAAAKDLRGKHWNIVKGKGITEIPSNDFSHYDNFLDAAFLFNVVPASVQNLDLSDLERYFALGRGYQGGKGDVRALPMKKWFNTNYHYIVPKFEKDTQVKLAGHKIFDEFQEAKELGLNTRPVLVGPFTFLQLSDFEEGVKADDFVDSLVAAYQEVFAKLAELGATRIQLDEAALVKDLTAEEKALFLNLYNKLLADKKGLEVLLQTYFGDVRDVYADLVNLPVDAIGLDFVEGKKTLELVKGGFPADKTLYVGIVNGKNIWRNNYEKSLAVLEQIPAENIVLTSSCSLLHVPFTTANEEFEPALLNHFAFAVEKLDEIRDLDAIRNGQGSEALAANKELFATERVGENAELRARIAGLTDADYTRLPAFAEREAIQGEGFKFPAFPTTRIGSFPQTKEVRAKRLAYRKGELSQKEYDAFPC

SEQ ID NO: 367 - protein, 160 aa
MLTGILKPTSGFCRINGKIPQENRQDYVKDIGVVFGQRTQLWWDLALQETYSVLKEIYDVPDAVFQKRMDFLNDVLDLKEFIKDPVRTLSLGQRMRADIAASLLHNPKVLFLDEPTIGLDVSVKDNIRRAITQINQEEETTILLTTHDLSDIEQFVIGFS

SEQ ID NO: 368 - protein, 73 aa
MKVINQTLLEKVIIERSRSSHKGDYGRLLLLGGTYPYGGAIIMAALAAVKSGAGLVTVGTDREKYPGSAQPFT

SEQ ID NO: 369 - protein, 53 aa
MXVINQSLLXXVIIDRPRSSLKGDYGRLPXLGGXYGGGGXTSXAAXXGXXXXA

SEQ ID NO: 370 - protein, 178 aa
MINRYSRPEMANIWSEENKYRAWLEVEILSDEAWAELGEIPKEDVALIRKKADFDIDRILEIEQETRHDVVAFTRAVSETLGEERKWVHYGLTSTDVVDTAYGYLYKQANDIIRRDLENFTNIIADKAKEHKFTIMMGRTHGVHAEPTTFGLKLATWYSEMKRNIGALRACGCWCRSW

SEQ ID NO: 371 - protein, 46 aa
MKTNDIVYGVHAVTEALLANTGNKLYLQEDLRGKNVEKVKELAVTF

SEQ ID NO: 372 - protein, 221 aa
MLLSAFHKYENQLDKVRFIGLHTGHLGFYTDYRDFELDKLVTNLQLDTGARVSYPVLNVKVFLENGEVKIFRALNEASIRRSDRTMVADIVINGVPFERFRGDGLTVSTPTGSTAYNKSLGGAVLHPTIEALQLTEIASLNNRVYRTLGSSIIVPKKDKIELIPTRNDYHTISVDNSVYSFRNIERIEYQIDHHKIHFVATPSHTSFWNRVKDAFIGEVDE

SEQ ID NO: 373 - protein, 137 aa
MLVPKRVKHRREFRGKMRGEAKGGKEVAFGEYGLQATTSHWITNRQIEAARIAMTRYMKRGGKVWIKIFPHKSYTAKAIGVRMGSGKGAPEGWVAPVKRGKVMFEIAGVSEEIAREALRLASHKLPVKCKFVKREAE

SEQ ID NO: 374 - protein, 221 aa
MYTVSGIAYRWFSTILALVSATSVFVLTTISLIGVETFSKIPVFGYVAKRFSAFFNPFADRADAGHQLANSYFAMVNGGWFGLGLGNSIEKRGYLPEAHTDFVFSIVIEEFGFVGASLILALLFFMILRIILVGIRAENPFNAMVALGVGGMMLVQVFVNIGGISGLIPSTGVTFPFLSQGGNSLLVLSVAVAFVLNIDASEKRAKLYRELENQPMNLLLK

SEQ ID NO: 375 - protein, 111 aa
MLLIVIIIGTFYFFNRARYLGVTYYSRFHFTILGCFFLTLAITALLMLQNYQFNIEIYQHNPLNFKYLSAWVITYVIYLPWVFIGNLGLKSYGEWAQKKFEQDMDELESGE

SEQ ID NO: 376 - protein, 68 aa
MLDVEAIRKDFPILDQIVNDEPLVYLDNAATTQKPLVVLKAINSYYEQDNANVHRGVHTLAERATASL

SEQ ID NO: 377 - protein, 174 aa
MGFNQPLSWLILHAKGLTESFIKASAQTGADRITYISCNVRNHGAVDIKLYQELGYELKKVQPVDLFXQTHHVETVALLSKLDVDKHISVEIELDEMDLTSAESKATYAQIKEYVWNKFELKVSTLYIAQIKKKCGIELREHYNKXKKDKQIIPQCTPEKEEAIMDALRXFKMI

SEQ ID NO: 378 - protein, 104 aa
LTEAGYVGEDVENILLKLLQVADFNIERAERGIIYVDEIDKIAKKSENVSITRDVSGEGVQQALLKIIEGTVASVPPQGGRKHPQQVDDSSGYKKYPLHRGWCF

SEQ ID NO: 379 - protein, 128 aa
MQEIIAEDIQKFGIIPELIGRLPVFAALEQLTVDDLVRILKEPRNALVKQYQTLLSYDDVELEFDDEALQEIANKAIERKTGARGLRSIIEETMLDVMFEVPSQENVKLVRITKETVDGTDKPILETA

SEQ ID NO: 380 - protein, 124 aa
MEGQSAMQSQEQDSNGAVKSIVSKSPGAISYLSLTYIDDSVKSMKLNGYDLSPENISSNNWPLWSYEHMYTLGQPNELAAEFLNFVLSDETQEGIVKGLKYIPIKEMKVEKDAAGTVTVLEGRQ

SEQ ID NO: 381 - protein, 191 aa
MEIKIETGGLRLDKALSDLSELSRSLANEQIKSGQVLVNGQVKKAKYTVQEGDVVTYHVPEPEVLEYVAEDLPLEIVYQDEDVAVVNKPQGMVVHPSAGHTSGTLVNALMYHIKDLSGINGVLRPGIVHRIDKDTSGLLMIAKNDDAHLALAQELKDKKSLPQILGDCSMEICLMIVVLIETPELANEKEP

SEQ ID NO: 382 - protein, 157 aa
MKILVTGFNPFGGEKINPALEAVKLLPSEINGAEVRWVEIPTVFYKSSEVLEAEILRYQPDAVLCIGQAGGRTGLTPERVAINQDDARIPDNEGNQPIDTPIRIDGASAYFSSLPIKAMVQAIKKQGLPAVVSNSAGTFVCNHLMYQALYLVDKEIP

SEQ ID NO: 383 - protein, 60 aa
MLRAGFHAYSIYDGTSSEQKPNTPDYEFYVDIRRKGIEAAIGAMIEHGDQELKLVGGEIH

SEQ ID NO: 384 - protein, 71 aa
MKFRKLACTVLAGAAVLGLAACGNSGGSKDAAKSGGDGAKTEITWWAFPVFTQEKTGDGVGTYEKSIIEAF

SEQ ID NO: 385 - protein, 58 aa
MALGTTLTVQAICLQTAGGSTQTATGTGSTTPGEMATGWKSPTLLFFNTSYFDLTGWS

SEQ ID NO: 386 - protein, 209 aa
MEAELKKLEVNLVNLAGQLASARHNLAQQLEAEIKQELQDLYMEKAQFQVRFSKGKFSREGNKMVEFYISTNPGEDFKPLVKVASGGELSRLMLAIKSAFSRKEGKTSIVFDEVETGVSGRVAQAIAQKIHKIGQHGQVLAISHLPQVIAIADYQFFIEKISNDHSTVSTVRLLTVEERVEEVAKMLAGDDVTEAALTQARELLRNREK

SEQ ID NO: 387 - protein, 131 aa
MMGENLFRSIKIRGEFLHMHVRMIPKSTPDTKFADVATHQPEYSRDNVAGTIVGFWTPEIFHGVSVAGYHLHFISDDLTFGGHVMDFVIKEGIIEVGAVDQLDQRFPVQDRQYLFAKFNVDEMKKDIEKAE

SEQ ID NO: 388 - protein, 119 aa
MAGSSRDHAAWALADYGFKVVIAGSFGDIHYNNELNNGMLPIVQPREVREKLAQLKPTDQVTVDLEQQKIISPVEEFTFEIDSKWKHKLLNSLDDIGITLQYEELIAAYEKQRPAYWQD

SEQ ID NO: 389 - protein, 359 aa
MNIYDQLQAVEDRYEELGELLSDPDVVSDTKRFMELSKEEASNRDTVIAYREYKQVLQNIVDAEEMIKESGGDADLEELAKQELKDAKAEKEEYEEKLKILLLPKDPNDDKNIILEIRGAAGGDEAALFAGDLLTMYQKYAEAQGWRFEVMEASMNGVGGFKEVVAMVSGQSVYSKLKYESGAHRVQRVPVTESQGRVHTSTATVLVMPEVEEVEYDIDPKDLRVDIYHASGAGGQNVNKVATAVRIVHLPTNIKVEMQEERTQQKNREKAMKIIRARVADHFAQIAQDEQDAERKSTIGTGDRSERIRTYNFPQNRVTDHRIGLTLQKLDTILSGKLDEVVDALVLYDQTQKLEELNK

SEQ ID NO: 390 - protein, 200 aa
MNNNFNNFNNMDDLFNQLMGGMRGYSSENRRYLINGREVTPEEFAHYRTTGQLPGNAETDVQMPQQASGMKQDGVLAKLGRNLTAEAREGKLDPVIGRNKEIQETSEILSRRTKNNPVLVGDAGVGKTAVVEGLAQAIVNGDVPAAIKNKEIISIDISGLEAGTQYRGSFEENVQNLVNEVKEAGNIILFFDEIHNSWCW

SEQ ID NO: 391 - protein, 292 aa
MQGQIIKALAGFYYVESDGQVYQTRARGNFRKKGHTPYVGDWVHFSAEENSEGYILKIHERKNSLVRPPIVNIDQPVVIMSVKEPDFNSNLLDRFLVLLEHKGIHPIVYISKMDLLEDRGELDFYRQTYGDIGYDFVTSKEELLSLLTGKVTVFMGQTGVGKSTLLNKLVPDLNLETGEISDSLGRGRHTTRAVSFYNLNGGKIADTPGFSSLDYEVSRAEDLNQAFPEIATVSRDCKFRTCTHTHEPSCAVKPAVEEGVIATFRFDNYLQFLSEIENRRETYKKVSKKIPK

SEQ ID NO: 392 - protein, 305 aa
MIITIPIKNQKDIGTPSDSVVVLGYFDGIHKGHQELFRVANKAARKDLLPIVVMTFNESPKIALEPYHPDLFLHILNPAERERKLKREGVEELYLLDFSSQFASLTAQEFFATYIKAMNAKIIVAGFDYTFGSDKKTAEDLKDYFDGEVIIVPPVEDEKGKISSTRIRQAILDGNVKEAGKLLGAPLPSRGMVVHGNARGRTIGYPTANLVLLDRTYMPADGVYVVDVEIQRQKYRAMASVGKNVTFDGEEARFEVNIFDFNQDIYGETVMVYWLDRIRDMTKFDSVDQLVDRLKADEEVTRNWS

SEQ ID NO: 393 - protein, 129 aa
MATTELIELAIETSKHAYVPYSHFPIGAVLVAKDGNVYTGVNIENASYPLTNCGERTAIFKAISEGQREFSELIVYGQTEKPISPCGACRQVMVEFFEQDLKVTLVAKDKSTVEMTVGELLPYSFTDLN

SEQ ID NO: 394 - protein, 119 aa
MDLMRTFDKVDALLDQLSANSKDKTALLESTKAILVLNHQIQSKASASEETSPARNAEANGDNTSAENQPNATAESNIETASDENKPSNTRDSKPAESTSENKTTESSTTTGNQEKPVE

SEQ ID NO: 395 - protein, 118 aa
MVRYVIEKSGHTDWDGRKIYQEAAAGNALCQEAIERMNRNLAQGLLNIQYLIDPDVISLGGSISQNPDFIQDVKKAVDNFVDTYEEYTVAPVIQACTYHADANLYGALVNWLQEEKQW

SEQ ID NO: 396 - protein, 91 aa
MQGDFQSNIYEQVEGHFDHVISNPPIRAGKQVVHEIIEKSKDFLETGGDLTIVIQKKQGAPSAKSKMEDVFGNCEILKKDKGYYILRSVKE

SEQ ID NO: 397 - protein, 119 aa
MDGVLRNLLFGQYEGWRTEFHGEHALGKDSSQYILTDQWKFIWFPVLNHYQLFDMKKDPHEMNDLYPSEKYQPIVRQMKKKLVDFLRYREEGFVVDEELVPVELSKITPTLTKTGDSQS

SEQ ID NO: 398 - protein, 358 aa
LFSIILSVALISLVSLVTGPILPFLSKPASQDCDIFIALTEHDEVNMIAAVLAKKMGAKETIVRVRNPEYSNSYFKEKNILGFSLIVNPELLAARAIANIIDFPNALSVERFAGGRVSLMEFVVKSTSGLCQMPISDFRKKFGNVIVCAIERDHQIIIPSGDMTVQDKDRIFVTGNRVDMILFHNYFKSRAVKSLLIVGAGRITYYLLGILKDSRIDTKVIEINPEIASFFSEKFPNLYIVQGDGTAKDILLEESAQHYDAVATLTGVDEENLITSMFLDRVGVQKNITKVNRTSLLEIINAPDFSSIITPKSIAVDTIMHFIRGRVNAQYSRPSSHAPSSQWPNRNPAIPYQGKPIK

SEQ ID NO: 399 - protein, 241 aa
MLFTALQMNTDILAISQEVGDWRIDLASSQTEMQLATSFISPSQALLNLPQEDFDSCKSSAQADWENLLHRFDIIEIGEADRTFFDHCLYRLFLFPQTFYEINESGQAIHMDLATGTVKPGVLFSNNGFWDTFRTTFPLFALIIPEHYQRFLEGFLNSYRDTGFLPKWLAPDERGMMPGTLLDGIIADSACKDMAPDLEGELFQAMLRNSQQSRPSRNQWPPRTSPIPRTRLPLYRPPRKC

SEQ ID NO: 400 - protein, 146 aa
MMVSHACAVKLYKEKGYKGEIGVVHALPTKYPLDPENPADVRAAELEDIIHNKFILDATYLGRYSAETMEGVNHILSVNGGSLDLREEDFTALEAAKDLNDFLGINYYMSDWMEAFDGETEIIHNGKGEKGSSKYQIKGIGRLVAP

SEQ ID NO: 401 - protein, 183 aa
MNTSLKLSKQLSFGEEIANSVTHAVGAVIMLILLPISSIYSYEAHGFLSSIGVSIFVISLFLMFLSSTIYHSMAYGSTHKYVLRIIDHSMIYVAIAGSYTPVVLTLMNNWFGYLIIVIQWGTTIFGILYKIFAKKVNEKFSLALYLIMGWLVLAIIPAIISQXTPVFWILMVTGGLCYTVGAD

SEQ ID NO: 402 - protein, 96 aa
MLENLCELPFRPEAQRVVTKGYLNLQNRNDLLLVEDITADEWMDVQFELQPTIYKLKEGDTLRLVLYTTDFEITIRDNTDYHLTVDLAQSMLTLPC

SEQ ID NO: 403 - protein, 116 aa
MNKSEHRHQLIRALITKNKIHTQAELQALLAENDIQVTQATLSRDIKNMNLSKVREEDSAYYVLNNGSISKWEKRLELYMEDALVWMRPVQHQVLLKTLPGLAQSFGSIIDDFELP

SEQ ID NO: 404 - protein, 73 aa
MGKLSSILLGTVSGAALALFLTSDKGKQVCSQAQDFLDDLREDPEYAKEQVCEKQTEVKEQATDFVLNNKRTG

SEQ ID NO: 405 - protein, 89 aa
MYLGDLMEKAECGQFSILSFLLQESQTTVKAVMEETGFSKATLTKYVTLLNDKALDSGLELTIHSEDENLRLSIGAATKGRDIRSLFFG

SEQ ID NO: 406 - protein, 260 aa
MRFYFMENVVVHIISHSHWDREWYLPFESHRMQLVELFDNLFDLFENDPEFKSFHLDGQTIVLDDYLQIRPENRDKVQRYIDEGKLKIGPFYILQDDYLISSEANVRNTLIGQQEAAKWGKSTQIGYFPDTFGNMGQAPQILQKSGIHVAAFGRGVKPIGFDNQVLEDEQFTSQFSEMYWQGVDGSRVLGILFANWYSNGNEIPVDKDEALTFWKQKLSDVRCLRFDQPMVDDETAVTTSLSQEKSERSHSVLQMNSSRM

SEQ ID NO: 407 - protein, 125 aa
LTASPLKKSIKKKNRKLTNKXEKHMSKIIGIDLGTTNSAVAVLEGTESKIIANPEGNRTTPSVVSFKNGEIIVGDAAKRQAVTNPDTVISIKSKMGTSEKVSANGKEYTPTRNLSYDPSILERLR

SEQ ID NO: 408 - protein, 305 aa
MDSTPVIXGAMLISPLMTPILGVGLSLAIFDFKLLRKSFKILAIQILASLIASTLYFYLSPISYASSEIVARTSPTIWDVLIAFVGGIAGIIGARKKETNNIVPGVAIATALMPPLCTVGYAIASANLKFIIGSSYLFLINCSFIVIATYIGVRLMMVKKHYFKDNEEDSKMRRILLLVAVLLMIPSFISATTLVRETLKKESLKKFISEQFQGHNILKKTYSKKTHTLKLTISGNYLTEEELDMISSKRGDYGLSDVSVQVSQLSDSEQLSKEELVEYFFQYIKDKEAKEKEKANKFYTESEEQ

SEQ ID NO: 409 - protein, 73 aa
MIARSYQEMDDLDTAYEHYQELTGDLKDNPEFLEHYIYLLRELGHFEEAKVHAHTYLKLVPDDVQMQELFERL

SEQ ID NO: 410 - protein, 191 aa
MLEETQEIVAGRVASVETLKRIEELGFDFVCLTGNPGTGVSNREIIKAVQTAKENFSGLIIAGKMHGAGVNEPVAELSVAEQLLEAGADVILVPAVGTVPAFHDQELREVVDLVHSKGGLVLSAIGTSQETSDTDTIKEIALRNKICGVDIQHIGDAGYGGLATVDNIYALSKAIRGVRHTVSRLARSVNR

SEQ ID NO: 411 - protein, 105 aa
MAKVTIMLACAAGMSTSLLVTKMQKAAEDKGLDAEIFAVPAPEAEEIVATKEVNVLLLGPQVRYLLGDFQEKLKDRQIPVAVIPMTDYGMMNGSKVLDLAESLLD

SEQ ID NO: 412 - protein, 72 aa
MLQRQQASAIIDARKMIVDGAVGMVEMALERLNEGELVELDEERKAAMVSNLLVVLCGNHDAQPIVNTGSLY

SEQ ID NO: 413 - protein, 53 aa
MVAGFTGEFVKSKDAVEAFKWGVACGTATTFSDDLATAEFIKETYGKVEVEKR

SEQ ID NO: 414 - protein, 127 aa
MYESPVGFRHGPKSLINDNTVVLVFGTTTDYTRKYDLDLVREVAGDQIARRVVLLSDQAFGLENVKEVALGCGGVLNDIYRVFPYIVYAQLFALLTSLKVENKPDTPSPTGTVNRVVQGVIIHEYQK

SEQ ID NO: 415 - protein, 101 aa
MSHDHNHDHEERELITLVDEQGNETLFEILLTIDGKEEFGKNYVLLVPVNAEEDEDGQVEIQAYSFIENEDGTEGELQPIPEDSEDEWNMIEEVFNSFMEE

SEQ ID NO: 416 - protein, 98 aa
MEMQTSAQLLTNKIFLKNPLKALVEEKYGIEYEEFTNPWHAAISSFVAFFLRSLPPMLSVTIFPSEYRIPATVLIVGVALLLTGYTSARLGKDPTRTV

SEQ ID NO: 417 - protein, 226 aa
MPWNAAYVEPSRRPADGRYGENPNRLYQHHQFQVVMKPSPSNIQELYLESLEKLGINPLEHDIRFVEDNWENPSTGSAGLGWEVWLDGMEITQFTYFQQVGGLATGPVTAEVTYGLERLASYIQEVDSVYDIEWADGVKYGEIFIQPEYEHSKYSFEISNQEMLLENFDKFEKEAGRALEEGLVHPAYDYVLKCSHTFNLLDARGAVSVTEPCRLYRSVSVTWPVL

SEQ ID NO: 418 - protein, 49 aa
MSKELTFQEIILTLQQFWNDQGCMLMQAYDNEKGAGTMSPYTFLRAYRT

SEQ ID NO: 419 - protein, 147 aa
MFITMGVGAAILLLIWIFFKQLLITSFDELLAKAMGMPVNFYHYLLMVLLTLVSVTAMQSVGTILIVAMLITPAATAYLYANSLKSMIFLSSTFGATASVLGLFIGYSFNVAAGSSIVLTAASFFLISFFIAPKQRYLKLKNKHLLK

SEQ ID NO: 420 - protein, 238 aa
MLRNRLETEFGKRVEVVDVIGYYELNQEKLKGIDFIVSAVDLSNLYFQIPVFKVSVFLKSDEMEMIRKAMVQMQVSSYVQSSKINKFENNGFRQYFSKENFLICTESDKVNLLEKMVESLSVGESNEFEQSLLYGIKQREELSSVVFSEKIAVPHPIQPFGTEEKVSVAICKDSLLWDNQSSHVQTSYFFYLHQYMGTEGLATVTKKIVSLTENDELQNQLISCNNFEDFINIFEKIK

SEQ ID NO: 421 - protein, 43 aa
MPRASFDQVNQVRQENGEPEFANPRNAAAGTIVSVGYSSSFQA

SEQ ID NO: 422 - protein, 78 aa
MRQQELLCQLDTAVVSKRNLATFLYQEASPSTRDSQEKGLKYLEQLGIVVNHKRIFGWKIDKIWNFIQEVGQERENLP

SEQ ID NO: 423 - protein, 151 aa
MALTEQKRARLEKLSDENGIISALAFDQRGALKRLMAQHQTEEPTVAQMEELKVLVADELTKYASSMLLDPEYGLPATKALDEKAGLLLAYEKTGYDTTSTKRLPDCLDVWSAKRIKEEGADAVKFLLYYDVDSSDELNQEKQAYIGAYRF

SEQ ID NO: 424 - protein, 174 aa
LNWILLQGLICQRDASYDMKQDDLDKVADYLFKTEEWTMYELILFGNLYSFYDVDYVTRIGREVMEREEFYQEISRHKRLVLILALNCYQHCLEHSSFYNANYFEAYTEKIIDKGIKLYERNVFHYLKGFALYQKGQCKEGCKQMQETMHIFDVLGLPEQVAYYQEHYEKFVKS

SEQ ID NO: 425 - protein, 149 aa
MYPDDSLTLHTDLYQINMMQVYFDQGIYNKKAVFEVYFRQQPFKNGYAVFAGLERIVNYLEDLRFSDSDIAYLESLGYHGAFLDYLRNFKLELTVRSAQEGDLVFANEPIVQVEGPLAQCQLVETALLNIVNYQTLVATKHSYSFGYRR

SEQ ID NO: 426 - protein, 66 aa
MLVLNYVYAVPLYAKFANFDIGKILGLSNYLMTMVLPFNLIEGVIFSVSFWLLYVLLKPTLKHYER

SEQ ID NO: 427 - protein, 70 aa
MEESKELNAVIDVIMLAGTILLKSGSEIHRVEDTMIRIAHSQGIVDCNVLAMPAAIFFSIENTNISRMNA

SEQ ID NO: 428 - protein, 104 aa
LFEKKGLTVDANGNATVDLTFKEDSEKGKSRFGVSLKFKDTNNNVFVGYDKDGWFWEYKSPTTSTWYRGSRVAAPETGSTNRLSISLQVRRSGKCQANKDVNLL

SEQ ID NO: 429 - protein, 139 aa
MVENPEGFHFDDLQLQTHADNDIEALVSLANMDGEKVEFNATGQGSVEAIFNAIDKFFNQSVRLVSYTINAVTDGIDAQDRVLVTVENRDTETIFNAAGLDFDVLKASAIAYINANTFVQKENAGEMGRSVSYHDMPSV

SEQ ID NO: 430 - protein, 193 aa
MAKKKIKKEKIDNVGIHSFSKKADIFFSIISGLIALSCILPFVFVIIISVTDEKSLLQYGYSFFPSQFGLDGFEFLAQFKDKILQALFISVFVTVVGTLTNVFITTTYAYAISRTTFKYRRFFTIFVLLSMLFNAGLVPGYIMVTRVLQLGDTVWAFDCSNASLTIQYHLDAFFFQEDHSRSHSRIGSYRWCQ

SEQ ID NO: 431 - protein, 97 aa
MKTRKIPLRKSVVSNEVIDKRDLLRIVKNKEGQVFIDPTGKANGRGAYIKLDNAEALEAKKKKVFNRSFSMEVEESFYDELIAYVDHKVKRRELGLE

SEQ ID NO: 432 - protein, 169 aa
MIRKVEMADVEVLAKIAKQTFRETFAYDNTEEQLQEYFEEAYSLKTLSTELGNPDSETYFIMQEEEIAAFLKVNWGSAQTERELEDAFEIQRLYVLQKFQGFGLGKQLFEFALELATKNSFSWAWLGVWEHNTKAQAFYNRYGFEKFSQHHFMVGQKVDTDWLLRKKLR

SEQ ID NO: 433 - protein, 154 aa
MKSIIDVKNLSFRYKENQNYYDVKDITFHVKRGEWLSIVGHNGSGKSTTVRLIDGLLEAESGEIVIDGQRLTEENVWNIRRQIGMVFQNPDNQFVGATVEDDVAFGLENQGLSRQEMKKRVEEALALVGMLDFKKREPARPIRCQKHVWPLQVL

SEQ ID NO: 434 - protein, 182 aa
MQVAFTGETSPQVLKEIGTDYVVIGHSERRDYFHDTDEDVNKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 435 - protein, 168 aa
MGKKRWARNGFESNDASYAQVVSLYDDTSISVSNNETDKVLAGSLYTDTNEQGLTIPSSLLKNWNEQTGKNLTANDLIGKSVSVSIVESAAETSKIAQFQTKIVRVINDEDDMEDSNSFMLSHQMETILKEAGFTKAVSYFILELKDPSQTKVVTEELQKNKKYTVLS

SEQ ID NO: 436 - protein, 141 aa
MMHTYLQKKIENIKTTLGEMSGGYRRMVAAMADLGFSGTMKAIWDDLFAHRSFAQWIYLLVSGSFPLWLELVYEHRIVDWIGMICSLTGIICVIFVSEGRASNYLFGLINSVIYLILALQKGFYGEVLTTLYFTVMQPIGL

SEQ ID NO: 437 - protein, 70 aa
MMRHKFHGSGLVQKKTGSIPLEIELTQKGIVTKVNHLKQARLSGYVGHVQVVSLAPEDLQIIKGAPWIRR

SEQ ID NO: 438 - protein, 237 aa
MRGIHFVQIPTSLTAQVDSSIGGKTGVNTPFAKNMVGTFAQPDGVLIDPLVLETLGKRELIEGMGEVIKYGLIEDPELWALLTGLNGSVESILEHAETLIEHSCQVKRKMVVEDELDNGIRLYLNFGHTIGHAIEATAGYGKVMHGEAVAMGMVQISKIAEEKGLMPAGITQSITEMCQKFGLPVDYENWEVDKLYQALTHDKKARGNTLKLVLVPELGSATIHPVSLEEMKDYLVK

SEQ ID NO: 439 - protein, 68 aa
MGKEKVWLPRKQGLPGLAYYVIEVAHKEELLTIAQRAQEVDVPIKWMTSSQLEITDSDGIVTCIRLAR

SEQ ID NO: 440 - protein, 97 aa
MCITPVASLAPDVFCVSMNGLSKSHRIAGFRVGWMVLSGPKTHVKGYIEGLNMLSNMRLCSNVLAQQVVQTSLGGHQSVDELLLSWWTNLRAKKFHL

SEQ ID NO: 441 - protein, 143 aa
MRLEQDCPVFLKIKEKDMASKMLHTCLRVENLEKSIAFYQDAFGFKELRRRDFPDHAFTIVYLGLEGDDYELELTYNYDHGPYVVGDGFAHIALSTPDLEALHQEHSTKGYEVTEPNGLPGTAPNYYFVKDPDGYKVEVIREK

SEQ ID NO: 442 - protein, 30 aa
MLDGMDISNTYQDKLEELEKEAKTVVFLSC

SEQ ID NO: 443 - protein, 72 aa
MATFYVPAVNLIGKGVVNEVGPYIKELGYKKALLVTDKYIEGSDILPKVLKPLDTEGIEYVIFSDVDAKPYL

SEQ ID NO: 444 - protein, 53 aa
MPSFDAQHPEILETIRDTKDLPEEAVLDAAITEFLNQSSFPIRIEVSDGSVSK

SEQ ID NO: 445 - protein, 188 aa
MILLIDNYDSFTYNLAQYIGNFAEVQVLRNDDSKLYEEAEKADGLVFSPGPGWPVDAGKMEDMIRDFAGKKPILGICLGHQAIAEVFGGKLGLAPKVMHGKQSNINFEAPSVLYQGIEDGRAVMRYHSILIEEMPEDFEVTARSTDDQAIMGIQHKNLPIYGFQYHPESIGTPDGLSSIRNFIEEVVK

SEQ ID NO: 446 - protein, 136 aa
LLAFVAWNFVTFFLCPPTRNEISYQHAAPTFTGVTAFLMYFFYPVIAGPIFEDMIYRGLVMTALEKGKKWGLDVLGSAVLFGVSHISNHGWVLTDFVFYMGGGLIFAVLFRMTKSIYWPIGLHIVYNGIGQLLMLL

SEQ ID NO: 447 - protein, 272 aa
MTVDREGFEAAMKEQQERARASAVKGGSMGMQNETLQNITVESAFNYNASQLSSKLVAIVADNAEVEAVSEGTASLIFAETSFYAEMGGQVADYGQILDESGKVVATVTNVQKAPNGQALHTVEVLAPLALNQEYTLAIDSNRRHRVMKNHTATHLLHAALHNILGNHATQAGSLNEVEFLRFDFTHFQAVTAEELRAIEQQVNEKIWEALEVKTVETDIDTAKENGRSNSCSPGGSTNSXXAATAVELHFXFPLMKVNCXLGLXWPXRFPF

SEQ ID NO: 448 - protein, 251 aa
MDAEVSKNLRLILERKGMTILTGTKLQEIIEENGQLRIKVEGKDNIIASKALLSIGRMPDLEGIGEVEFELDRGCIKVNEYMETSVPGIYAPGDINGTKMLAHAAFRMGEVSAENALKGNHAVAKLNLTPAAIYTLPEVAAVGLTEEQAREKYDVAIGKFNFAANGRAIASDAAQGFVKVIADKKYGEILGVHIIVPAAAELINEASSIIEMEITVEEMLKTIHGHPTYFEVMYEAFADVLGMAIHSPKKK

SEQ ID NO: 449 - protein, 134 aa
LIVETILGILGSRGIHLAVQGCEHVNRALVVERQVAEQFDLEIVSVHPTLHAGGSGQLAAFKFMQDPVEVEFIKAHAGLDIGDTAIGMHVKHVQVPIRPILREIGHAHVTALASRPKLIGGARAHYPQDAIRKS

SEQ ID NO: 450 - protein, 81 aa
MKIVSGIYGGRPLKTLEGKTTRPTSDKVRGAIFNMIGPYFEVGRVLDLYAGSGGLSIEAVSRGMSSAVLVERDRKAQTIRG

SEQ ID NO: 451 - protein, 163 aa
MRFVKEFGAVFLIGIGGELPDGKPHDGRAPDYDDWTSESENGYKGLNGDILVWNESLGGAFELSSMGIRVDEETLRRQVEITGDEDRLELEWHKSLLNGLFPLTIGGGIGQSRMAMFLLRKRHIGEVQTSVWPQVSPRYLRKYFVENRTARFGFLSLFVYNLV

SEQ ID NO: 452 - protein, 231 aa
LFEVEEVSDHGLTLYTERTDGTGGFPGNLKIWISYHLEETGASMNSIYKVTTDQDTLVNPTNHSYFNLSGDFTQTIDRHVFQLNTEGIYSIAPDGVPAKTPEANRDVVKHIYNGALLKDIFAEEDEQIQLASGLDHPFALPAGHDNAGFLYDQNSGRFLLFKTEAPCFVVYTANFVDESVIIGGQPMLQHNGIALEAQALPDAIHSDLKGQVILKAGQTFTSKTRYELVVK

SEQ ID NO: 453 - protein, 117 aa
MINTLVGMRFDLKTRKPILANGTGGMSGPAVFPVALKLIRQVAQTTDLPIIGMGGVDSAEAALEMYLAGASAIGVGTANFTNPYACPDIIENLPKVMDKYGISSLEELRQEVKESLR

SEQ ID NO: 454 - protein, 76 aa
MYNKVIMIGRLTSTPELHKTNNDKSVARATIAVNRRYKDQNGEREADFVQYGPYGARTSQKTLASLRQPKGSLHFR

SEQ ID NO: 455 - protein, 132 aa
MVKSSIQGPRLSKIWGSTRQESYRLCLGARLVYSATKAAVKTFSDGLRIDTIATDIKVTTIQPGIVETDFSTVRFHGDKERAASVYQGIEALQAQDIADTVVYVTSQPRRVQITDMTIMANQQATGFMIHKK

SEQ ID NO: 456 - protein, 179 aa
MKSELRKQVLHEMKALSQEQKQAIDQALTERILQHPFYQEAKVIATYLSFSHEFQTRELIEQALKDGKRVLTPKTYPKGRMDFVVYDPQQLVKTSFGLLEPQGDLEVVDVSKIDLIHVPGLAFTTKGYRIGYGGGYYDRYLEHFSGRALSTIYPCQIQDFIPENHDIPVQEVLIDEGNL

SEQ ID NO: 457 - protein, 169 aa
MDSLTWLNDLIYPMMVVNQTIPTIAIAPILVLWLGYGILPKIVLIILTTTFPIIVSILDGFRHCDKDMLTLFSLMRAKPWQILWHFKIPVSLPYFYAGLRVSVSYAFITTVVSEWLGGFEGLGVYMIQSKKLFQYDTMFAIIILVSIISLLGMKLVDISEKYVIKWKRS

SEQ ID NO: 458 - protein, 71 aa
MNVGYEKAFLMQTSLNLPTSEIISTYVYKVGLVSGDYSYSTAVGLFNAVINVVLLVAVNQIVKRMNNGEGI

SEQ ID NO: 459 - protein, 81 aa
MKRMLSGLNVVFSWMFTIKKNDGKTTIGTAKDHPTWVNRTPKGTFSPEGYPLYHYQTYILEDFIEDGSHRDQLDEATTGTN

SEQ ID NO: 460 - protein, 75 aa
MALVYDAKVAEAKRLSEALLMLDTSRIVARGYAIVKKEESVVDSVESLKKKDQVTLLMRDGQVELEVKDVKTKEI

SEQ ID NO: 461 - protein, 109 aa
MSQAQYAGTGRRKNAVARVRLVPGTGKITVNKKDVEEYIPHADLRLVINQPFAVTSTVGSYDVFVNVVGGGYAGQSGAIRHGIARALLQVNPDFRDSLKRAGLLTRDSR

SEQ ID NO: 462 - protein, 165 aa
MAGASLMFFGFLGFESISNGGSVDEVKTPQKNIPRGIVLSLSIVTILYALVTLVLTGVVHYSHLNVDDAVAFALRSVGISWAANYVSLVAILTLITVCISMTYALSRMIYSLASDGLVPAAFKELTKTSKIPKNATILTGLASAVAAGMFPLASIAAFLNICTLA

SEQ ID NO: 463 - protein, 126 aa
MNKKERLEKIRRLVTDYQIGTQEEIVEHLKEAGITATQATVSRDIKELGIVKIPLRDNTYVYELPKSIVKSLQLAEDNIESAELMDKMINLQVIPGNTAFVKAQLIETFADKIFSCLTDDSGPVXG

SEQ ID NO: 464 - protein, 111 aa
MNTNLASFIVGLIIDENDRFYFVQKDGQTYALAKEEGQHTVGDTVKGFAYTDMKQKLRLTTLEVTATQDQFGWGRVTEVRKDLGVFVDTGLPDKEIVVVTRYSPCAQGTLA

SEQ ID NO: 465 - protein, 255 aa
MYLKEIEIQGFKSFADKTKVVFDQGVTAVVGPNGSGKSNITESLRWALGESSVKSLRGGKMPDVIFAGTESRKPLNYASVVVTLDNHDGFIKDAGQEIRVERHIYRSGDSEYKIDGKKVRLRDIHDLFLDTGLGRDSFSIISQGKVEEIFNSKPEERRAIFEEAAGVLKYKTRRKETESKLQQTQDNLDRLEDIIYELDNQIKPLEKQAENARKFLDLEGQRKAIYLDVLVAQIKENKAELESTEEESWLRFKNS

SEQ ID NO: 466 - protein, 26 aa
MDDYNATQASTIAVMPVRYEEVLLMV

SEQ ID NO: 467 - protein, 101 aa
MRSLNFMRALLTDKQMNYIELYYADDYSLAEIAEEFGVSRQAVYDNIKRTEKILEDYEMKLHMYSDYIVRSQIFDQILDRYPKDDFLQEQIEILTSIDNRE

SEQ ID NO: 468 - protein, 140 aa
MGWEIGITPSTVLVSHLLVQESTSPDLLVNEFLLFAIGTGFALLVNLYMPSREEEIQHYHTLVEEKLKDILQRFKYYLSRGDGRNRAQLVAELDTLLKEALRLVYLDHSDHLFHQTDYHIHYFEMRQRQSRIPEKHGPTD

SEQ ID NO: 469 - protein, 53 aa
MELLANANKIMEGKVVLNWDIQYLGWGDYGKENVSYQHHLVKTMISPLQITIL

SEQ ID NO: 470 - protein, 86 aa
MERNNRKVLVGRVVSDKMDKTITVVVETKRNHPVYGKRINYSKKYKAHDENNVAKEGDIVRIMETRPLSATKRFRLVEVVEEAVII

SEQ ID NO: 471 - protein, 86 aa
MHRKPRGVDFGEGSIVQKVKAMIPILILLFATSLKRADSLAIAMEARGYQGGKGRSQYRQLKWTLKDTLTILVILVLGCCLFFLKS

SEQ ID NO: 472 - protein, 133 aa
MNFTLINWRIRMQYLEKKEIKEIQLALLDYIDETCKKHDIPYFLSYGTMLGAIRHKGMIPWDDDIDISLYREDYERLLKIIEEENHPRYKVLSYDTSSWYFHNFASILDTSTVIEEHVKYKRHDTSLFIDVSH

SEQ ID NO: 473 - protein, 167 aa
LRVAYFKVHHPIYYYCAYFSIRAKAFDIKTMGAGLEVIKRRMEEISEKRKNNEASNVEIDLYTTLEIVNEMWERGFKFGKLDLYCSQTTEFLIDGDTLIPPFVAMDGLGENVAKQLVRAREEGEFLSKTELRKRGGLSSTLVEKMDEMGILGNMPEDNQLSLFDELF

SEQ ID NO: 474 - protein, 85 aa
MSENQQALNHVVSMEDLTVDQVMKLIKRGIEFKNGAQIPYEDHPIVSNLFFEDSTRTHKSFEVAEIKLGLERLDFDVKTSSVNKG

SEQ ID NO: 475 - protein, 151 aa
MSMFLDTAKIKVKAGNGGDGMVAFRREKYVPNGGPWGGDGGRGGNVVFVVDEGLRTLMDFRYNRHFKADSGEKGMTKGMHGRGAEDLRVRVPQGTTVRDAETGKVLTDLIEHGQEFIVAHGGRGGRGNIRFATPKNPAPEISENGEPGSGT

SEQ ID NO: 476 - protein, 81 aa
MGSFLMPKSEVYMKQESTVDLLLDVDQRPSDGKGILLSFQHVFAMFGATILVPLILGMPVSVALLCFQLFGTLILHDCYWF

SEQ ID NO: 477 - protein, 172 aa
MANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNVLPPFERGTWNSQSPKLFNATIDHILLPKNHYYVKDLDIVSFQNSDHRCIFTEITF

SEQ ID NO: 478 - protein, 111 aa
MNLGADGVISVASHTNGDEMHEMFTAIAESDMKKAAAIQRKFIPKVNALFSYPSPAPVKAILNYMGFEAGPTRLPLVPAPEEDVKRIIKVVVDGDYEATKATVTGVLRPDY

SEQ ID NO: 479 - protein, 127 aa
MESLIQTYLPNVYKMGWSGQAGWGTAIYLTLYMTVLSFIIGGFLGLVAGLFLVLTAPGGVLENKVVFWILDKITSIFRAVPFIILLAILSPLSHLIEKTSIGPNASPCPTFFCSLCLLCPSGAGCLG

SEQ ID NO: 480 - protein, 96 aa
MDSQDNKRKWKNRDLISSLEFAITGIFTAIKEERNMRKHAVTALVVILAGFGFQVSRIEWLFLLLSIFLVVAFEIINSAIENVVDLASHYHFSHAG

SEQ ID NO: 481 - protein, 307 aa
LSEIDEVILVGGSTRIPAVVEAVKAETGKEPNKSVNPDEVVAMGAAIQGGVITGDVKDVVLLDVTPLSLGIETMGGVFTKLIDRNTTIPTSKSQVFSTAADNQPAVDIHVLQGERPMAADNKTLGRFQLTDIPAAPRGIPQIEVTFDIDKNGIVSVKAKDLGTQKEQTIVIQSNSGLTDEEIDRMMKDAEANAEADKKRKEEVDLRNEVDQAIFATEKTIKETEGKGFDAERDAAQAALDDLKKAQEDNNLDDMKAKLEALNEKAQGLAVKLYEQAAAAQQAQEGAEGAQATGNAGDDVVDGEFTEK

SEQ ID NO: 482 - protein, 79 aa
MILAFLLSLCSEADAFIGASLLSSFGLAPVLAFLVIGPMLDIKNILMMKNYLKARFISHFITIVTLVVLVYSLLIGVIL

SEQ ID NO: 483 - protein, 246 aa
LYNIIFLSSMWEPYGQLSDLPVAVVNNDKEASYNGNTMAIGKDMVSNLKENKTLDFHFVDEEEGKKGLEDGDYYMVVTLPSDLSEKTTTLSNIQSTAAYQSLTSEQQTEISDSVSQNSTDSIQSAQSIVALVQDLQGSLENLQNQSSNLSTLKNQSNQVSPITSTSLIGLSSGLTEIQGDVTSKLVPASQSIASGVNAYTTGVDKVSQGASQLSEKNATLTGSLDQLVSGSNTLTQKSSRLTAGVG

SEQ ID NO: 484 - protein, 142 aa
MADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSDVWAQFITCHQSRRVVLRRLCRVISMPWGLFSMRC

SEQ ID NO: 485 - protein, 224 aa
MLATAILGVVIEFLAYRPLRHSTRIAVLITAIGVSFLLEYGMVYLVGANTRAFPQAIQTVRYDLGPISLTNVQLMILAISLILMILLQVIVQKTKMGKAMRAVSVDSDAAQLMGINVNRTISFTFALGSALAGAAGVLIALYYNSLEPLMGVTPGLKSFVAAVLGGIGIIPGAALGGFVIGLLETFATAFGMSDFRDAIVYGILLLILIVRPAGILGKNVKEKV

SEQ ID NO: 486 - protein, 168 aa
MSLAMKEMGGDVSAAQTGVILTGLVYVLVATSIRFVGTKWIDKLLPPIIIGPMIIVIGLGLAGSAVTNAGLVADGNWKNALVAVVTFLIAAFINTKGKGFLRIIPFLFAIIGGYLFALTLGLVDFTPVLKANWFEIPGFYLPFSTGGAFKEYNLYFGPEPSLSXQSXX

SEQ ID NO: 487 - protein, 47 aa
MVKVLAACGNGMGSSMVIKMKVENALRKLNQTDFTVNSWPVSVKLKV

SEQ ID NO: 488 - protein, 56 aa
MASVGEAKGLAVGYDIVIASLHLIQELEGRTNGKLIGLDNLMDDKEITEKLSQALQ

SEQ ID NO: 489 - protein, 135 aa
LISLGLEHSLPLSSHLNISIGPLIQTWRIGFSDAKVAQPQKIESVLPLINPHGIELDSSTSTVFLKQKGMKIDLGCLAKGYSADKVAQFLRKEGVTSALINLGGNILTIGKNQARGDNPWQIGDSRTQPILGEII

SEQ ID NO: 490 - protein, 127 aa
MINKYFDGQIPAYVEGVTEFDHVLAEVAEKSIADFHTHMEAVDYPRALEAVWTLISRTNKYIDETAPWVLDKDEALRDQLASVMSHLAASIRVVAHLIEPFMMETSRAVLTQLGLEEVSSLENLKFG

SEQ ID NO: 491 - protein, 64 aa
MLVVIRFLKKLSLWLSKHRKPVPSMIQRRLSVGFNRATRLMEELEMAGVIGPAEGTKPRKVXQQ

SEQ ID NO: 492 - protein, 68 aa
MVGNPRLADLGFEEEAVGHHALVTGFQGQRQWTDHFPNGDFMETFLNTQFDWNGIRKPFVFACICDRE

SEQ ID NO: 493 - protein, 114 aa
MGTLWKLSSILSLTGMVFENHLYLLVFATENDSLNGVSMLFNYLLTNTPQIFADVRTYWSPEAVKRVTGHTLEGCAAAGFLHLINSGSCTLDGTGQATRNGKPVMKPFWELEES

SEQ ID NO: 494 - protein, 146 aa
MKLHELKPAEGSRKVRNRVGRGTSSGNGKTSGRGQKGQKARSGGGVRLGFEGGQTPLFRRLPKRGFTNINAKEYAIVNLDQLNVFEDGAEVTPVVLIEAGIVKAEKSGIKILGNGELTKKLTVKAAKFSKSAEEAITAKGGSVEVI

SEQ ID NO: 495 - protein, 63 aa
MGAAKLVVFANAVEDNPFMAGAFHGVGEADVIINVGVSGPGVVKRALEKVRGQSFDVSKPKTS

SEQ ID NO: 496 - protein, 155 aa
MTEKRLAWDEYFAAQALLIANRSTCKRAKVGAILVKDNKVISTGYNGSVSGTEHCIDHECLVIEGHCVRTLHAEVNAILQGAERGVPKGFTAYVTHFPCLNCTKQLLQVGCKRVVYINQYRMDDYAQYLYQEKGTELTHLPLETVQTALKEADLM

SEQ ID NO: 497 - protein, 188 aa
LWDQXQLDISKTNYLRVINAFTQIEAAKAYLFANSEFSGADWDTKISRDIFWEESMHGIYPENVGVNARLLNDEADFFDYLNHSAIFTAERDGQTYYFYPIQAGDYLATPEIQAFALNGDEVIIYPQEKDFETHRSYQYQDLTTRGTVEFRSVCTQPLDRTFASAAFHLGLLVNLDKLEAYLETAPFL

SEQ ID NO: 498 - protein, 124 aa
MDSKAKKDFENMVAIVAQKARSLSMGVCIVMQQPRSDSLSTNIREQLVNAIFLGAPTRESSHMMFGTTDVPQVKKDKGVGLYSTDREPPKEFHSPMFDRDVFEVILPVWEWAAKDYMKDEDEDV

SEQ ID NO: 499 - protein, 172 aa
MRHSIYDGKLGFDLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAQLGPQDPFLRGLMGQIRFTISRLVKTPLSTKLMCVTSLQILPLQKT

SEQ ID NO: 500 - protein, 176 aa
MCMFEVEEWLHSRIGLNFRSGLARIQQAVDLLGNPEQSYPIIHVTGTNGKGSTIAFMRELFMGHGKKVATFTSPHIVSINDRICINGQPIADADFIRLADQVKEMEKTLLQTPDQLSFFELLTLVAFLYFREQEVDLVLLEVGIGGLLDTTNVVTGELAVITSIGLDHQKTLGDSS

SEQ ID NO: 501 - protein, 182 aa
MISYDTRMLLLIAIFSVFLLYLSEIRFKDVSFVAVFATVFAVLNVLMVYLFSPEYGVGLYGERSVIWQGIGVYTLTSQELFYLLNLVIKYLCTIPLAIIFLMTTHPSQFASSLNQIGVPYKIAYSVSLTLRYIPDLQEEFFTIKMSQEARGMELSKKASLMQRIKGNLLIITPLIFSSLETH

SEQ ID NO: 502 - protein, 164 aa
MPISERTVYQIQSDQESLYAKFNPALTFVPVDFEDLSSQMTYNKCVTAFAQEPLDAAIQKISPELFDQYEIFKSREMLLEWSPKNVHKATGLAKLISHLGINQSQVMACGDEANDLSMIEWAGLGVAMQNAVPEVKAAANVVTPMTNDEEAVARAIEQYVLKEN

SEQ ID NO: 503 - protein, 119 aa
MKIKVVTVGKLKEKYLKDGIAEYSKRISRFAKFEMIELSDEKTPDKASESENQKILEIEGQRILSKIADRDFVIVLAIEGKTFFSEEFSKQLEETSIRRDFYSYFYYWGKFRIVIICKK

SEQ ID NO: 504 - protein, 88 aa
LEQAPGLSLADTLSLHYAMRNELTLSPVDFLLRRTNHMLFMRDSLDSIVEPVLDEMGRFYDWTEEEKATYRADVKAALAQNDLAELKN

SEQ ID NO: 505 - protein, 190 aa
MEDILYAPAEQNNGSAIEKAFGKNGKIAFQKSVDKYWKNLIFMFKNTPAAEGNDSTTESYMKGLWLSNHTYQWGGLMDTWKWYETGKWKLFASGNIGKSQGDRQWLTEPESMLGEEALGVYLNGGVVYNFEHPAYTYGVNNKESLLFSEVIKEFFRYVIAHPAPSKEKYLRIQKYSYMETIQIKEMVSSL

SEQ ID NO: 506 - protein, 86 aa
MTIELLTPFTKVELEPEIKEKKRKQVGILGGNFNPVHNAHLIVADQVRQQLGLDQVLLMPEYQPPHVDKKETIPEHHRLKMLEFGN

SEQ ID NO: 507 - protein, 61 aa
LLXGSLTXTHVAMTWQQLVVTKSIEKLNVKTRCVQPNHWQEPLVDPETGEILVEAGTIMTR

SEQ ID NO: 508 - protein, 74 aa
MKKKLLAGAITLLSVATLAACSKGSEGADLISMKGDVITEHQFYEQVKNNPSAQXVLLNMTIQKVFEKTIWLRA

SEQ ID NO: 509 - protein, 159 aa
MTGEIRNLQAQDYDASQIQVLEGLEAXXMRSGXYIGSTSKEGLHHLVWEIVDNSIDEALAGFASHIQVFIEPDDSITVVDDGRGIPVDIQEFTGRPAVETVFTVLHAGGKFGGGGYKVSGGLHGVGSSVVNALSTQLDVHVHKNGKIHYQEYRRGHVVA

SEQ ID NO: 510 - protein, 165 aa
MVLSKYYGVADGMNVEGRGSANFIKDNVLITSGLTTNYRHDYGKEADDIYVLPAVSPSQELFGKIKVKEVCYLKEFRNLNSKDAREYDLALLILEEPIGAKLGTLGLPTSQKNLTGITVTITGYPSYNFKIHQMYTDKKQVLSDDGMFLDYQVDTLEGSSGYYSL

SEQ ID NO: 511 - protein, 55 aa
MVENPILGTAEEGALFSLTAEGKIVVNNPHKADIEPSLLDHFFVDTHQDPSYQAC

SEQ ID NO: 512 - protein, 181 aa
LKKISKQELVNTRFSRLFAHFGQEKDGSFLAQRYQFYLAQQGQTLSGAHDLLDSLIERDYNLYAATNGITAIQTGRLAQSGLAPYFNQVFISEQLQTQKPDALFYEKIGQQIAGFSKEKTLMIGDSLTADIQGGNNAGIDTIWYNPHHLENHTQAQPTYEVYSYQDLLDCLDKNILEKITF

SEQ ID NO: 513 - protein, 161 aa
MKYDDAMALYGSDKPDTRFDMLLQDLTEVVKGVDFKVFSEALAVKAIVVNGLEPLTADNYSRKDIDKMTEVAKQYGAKGLAWVKVVDGELNGPVAKFLTGIQEELTTALALEDKDLVLFVADTLEVANATLGALRGRIAKELGLIDNDKFNFLWVVDWPMF

SEQ ID NO: 514 - protein, 70 aa
MVKYGVVGAGYFGAELARYMQKNDGAEITLLYDPDNAEAIAEELGAKVASSLDELVSSDEVDCVIVATPK

SEQ ID NO: 515 - protein, 97 aa
MKIDKYSAILGNTVGFHNMSTLTDHRPVASLPFGGKYRLIDFPLSSLANAGVRSVFGIFQQDNISSVFDHIRSGREWGLSTLLSHYYLGIYNTRVES

SEQ ID NO: 516 - protein, 95 aa
MTTFTIHTVESAPAEVKEILETVEKDNNGYIPNLIGLLANAPTVLEAYQIVSSIHRRNSLTPVEREVVQITAAVTNGCAFLCRRSQHPFPSNKSR

SEQ ID NO: 517 - protein, 64 aa
MKIGIIAAMPEELAYLVQHLDNAQEQVVLGNTYHTGTIASHEVVLVESGIGKVMSAMNCVANFG

SEQ ID NO: 518 - protein, 147 aa
MLHNAFAYVTRKFFKSIVIFLIILLMASLSLVGLSIKGATAKASQETFKNITNSFSMQINRRVNQGTPRGAGNIKGEDIKKITENKAIESYVKRINAIGDLTGYDLIETPETKKNLTADRAKRFGSSLTITGVNDSSKEDKFVSGPI

SEQ ID NO: 519 - protein, 170 aa
LRKNIGLVLQDLSIRELLSPISPCTKKSVMSRFKAAAAFVDADSFIQELPQRYDSPVSERGSSFSTGQRQLLAFARTVASQPKILILDEATANIDSETESLVQASLAKMRQGRTTIAIAHRLSTIQDANCIYVLDKGRIIESGTHEELLALGGTYHKMYSLQAGAMADTL

SEQ ID NO: 520 - protein, 165 aa
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVPSI

SEQ ID NO: 521 - protein, 93 aa
METALISVIVPVYNVAQYLEKSIASIQKQTYQNLEIILVDDGATDESGRLCDSIAEQDDRVSVLHKKNEGLSQARNDGMKQAHGDYLIFIDSK

SEQ ID NO: 522 - protein, 105 aa
MIKDIQGDKMNNNLLVLQSDFGLVDGAVSAMIGVALEESPTLKIHHLTHDITPYNIFEGSYRLFQTVDYWPEGTTFVSVVDPGVGSKRKSVVAKTAQKSIHCHAR

SEQ ID NO: 523 - protein, 144 aa
LVEVQKIKVIRTKKGENMAFLQADDSKKKLDVTLFSDLYRQVGQEIKEGAFYYVKGKIQSRDGRLQMIAQEIREAVAERFWIQVKNHESDQEISRILEQFKGPIPVIIRYEEEQKTIVSPHHFVAKSNELEEKLNEIVMKTIYR

SEQ ID NO: 524 - protein, 90 aa
MNSFKNFLKEWGLFLLILSLLALSRIFFWSNVRVEGHSMDPTLADGEILFVVKHLPIDRFDIVVAHEEDGNKDIVKRVIGMPGDTIRYEK

SEQ ID NO: 525 - protein, 109 aa
MVLQRNEINEKDTWDLSTIYPTDQAWEEALKDLTEQLETVAQYEGHLLDSADNLLEITEFSLEMERQMEKLYVYAHMKNDQDTREAKYQEYYAKAMTLLQPVRPSLFIL

SEQ ID NO: 526 - protein, 45 aa
MMIEKEDLTPFIHLQHHQQELTLKDGIVITAKLAQLAGVKVGQTL

SEQ ID NO: 527 - protein, 90 aa
LALFDEKDQFVQTVTIASHRKQKNFDIIKFKDMYHINTIEKYKGYSLKVAEEDLNDLDDGEFYYHEIIGLEVYEGDSLVGTIKENPATRC

SEQ ID NO: 528 - protein, 142 aa
MPVSRMWCSTSILRILTVWSTSMIKRKTYWKDLIQSFTGSKGRFLSILILMMLGSLALVGLKVTSPNMETTANAYLTTAQTLDLAVMSNYGLDQAYQEELKQTEGAEVEFGYLTDVTMDNGQDAIRLYSKPERISTFQLRKG

SEQ ID NO: 529 - protein, 37 aa
MYVATEREIAKHISRLGWYRNKDKFLKKCAQQLAKRF

SEQ ID NO: 530 - protein, 80 aa
MKHQQKFVPYKTLGADAVGMSTVPEVIVAAHSGLKVLGISCITNFAAGFQEELNHEEVVEVTERVKGDFKGLLKAILAEL

SEQ ID NO: 531 - protein, 143 aa
LLEILDFDWSIFLHDVEKTEKFVFLLLVFSMSITCLLALFWRGIEELSLRKMQANLKRLLAGQEVVQVADPDLDASFKSLSGKLNLLTEALQKAENHSLAHEEEIIEKERKRIARDLHDTVSQELFAAHMILSGFSQQALKFG

SEQ ID NO: 532 - protein, 67 aa
MNKLIAFIEKGKPFFEKLSRNIYLRAIRDGFIAGMPVILFSSIFILIAFVPNSWGFKWSDASCSLSD

SEQ ID NO: 533 - protein, 91 aa
MISKCCVRWAIPMGLKIILANMDGRSEGEPPYTLLDFFPDDFLIMIDESHMTIGQIKGMYNGDRSRKEMLVNYGFRLPSALDNRPLRREEF

SEQ ID NO: 534 - protein, 68 aa
MKQVEAKEEEQEQAEREAESKKEPYIYYILSFAKLADLVAFAKTVTFEMETSELYKMNERYYGLFDRL

SEQ ID NO: 535 - protein, 65 aa
MKAPQAAGIIHSDFEKGFIRAVTMSYEDLVKYGSEKAVKKAGRLREEGKEYIVQDGDIMEFRFNV

SEQ ID NO: 536 - protein, 66 aa
MIKTTSLVVLIGVVEVTKVGQQIIDSNRLTIPTGSFWVYGTILVLYFAVCYPISKLSTHLEKHWSN

SEQ ID NO: 537 - protein, 81 aa
MEVVMDNIIDVSIPVAEVVDKHPEVLEILVELGFKPLANPLMRNTVGRKVSLKQGSKLAGTPMDKIVRTLEANGYEVIGLD

SEQ ID NO: 538 - protein, 61 aa
MIFLIRMIYNAVDIYSLILVAFAVMSWFPGAYESSLGRWIVALVKPVLAPLQRLPLQIAGP

SEQ ID NO: 539 - protein, 44 aa
MKYISYRSEPNVNPESTTETFTSGAFFVDSDRFRGVRSFLFPYR

SEQ ID NO: 540 - protein, 71 aa
MTKISIYELVKRAGVSRAAFYRNYDSKEEISESVFKRTVHNIMEQMHHYDLKTDLYVVCFTFSGRPERKLE

SEQ ID NO: 541 - protein, 171 aa
LHQEPSLPATVTVEYDKGFPKTHKVTWQAIPKDKVDSYHTFEVLGKVEGIDLEARAKVSVDGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNHKRPSFKCS

SEQ ID NO: 542 - protein, 130 aa
MELRRPRLADKKAVLDMMTEFEKSQSAHDGGFWDTENFVYEEWLESNQEQEMGINLPEGWVPAIQLVAFSEKGQAVGFLNLRLRLSNFLLEEGGHIGYSIRPSERGKGYAKELSVRACKLLRKRTSRKLW

SEQ ID NO: 543 - protein, 98 aa
LLLIFAVIGVLVALIAQFYSAKAAVGFAKELTNDLYRHILSLPKDSRDRLTTSSLVTRLTSDTYQIQTGINQFLLSLFTSAHISFLVPFLWLIESQLS

SEQ ID NO: 544 - protein, 36 aa
MAYRISAELTFWFLIMVAILTIVIVRVISIGQSSLQ

SEQ ID NO: 545 - protein, 41 aa
MTTFKDRFLWGGAVAAHQLEGGWQEGGKGISVADVMTAGRH

SEQ ID NO: 546 - protein, 68 aa
MLDMLRDMQDKARKNKIDFAVAGYLNTSFIQKMNQLGIKCIIHYSSIPEIFDLEIDHPDHLKHIKEEK

SEQ ID NO: 547 - protein, 89 aa
MKNVELKEENMTFEEILPGLKAKRKYVRTGWGGAENYVQLFDTIEQNGLALEMTPYFLINVSGEGEGFSHVGARQFVMFWQRIGLELHD

SEQ ID NO: 548 - protein, 98 aa
LDSQTVSAKGYHFPLSEGTDLAIXTSEGTTSQYLKPDTSSYFSKSAYEKEMRTAADKYLSQDSIQITNENYMGGHGGYLRLSQMNLRVKTIQFNRLCL

SEQ ID NO: 549 - protein, 120 aa
MKKLVFVCLGNICRTPMAEFVMKSMTDNYEIQSRATSSWEHGNPIHKGTQGIFQEYEIPYDKNKTSLQISKEDFEAFDYIIGMDASNVSDLRQMCPVHCQDKIYSFSSESVPEPWYTGRF

SEQ ID NO: 550 - protein, 88 aa
MKTTFSYPKWAEIPNIDLYLDQVLLYVNQVCAPISPNKDKGLTASMVNNYVKNGYLTKPDKKKYQRQQIAPFDCYHNPQVLYFPIPRK

SEQ ID NO: 551 - protein, 105 aa
MPTAFYLFFSSMYQDTPGGPANFMRDYLISMTAFSMMSTAIFSFPVVLHTDKMSNWQKTLRHSPVNMVEYYLSKITVCWVDYLVFHSWWFFLSLGFLLEGVGLVL

SEQ ID NO: 552 - protein, 90 aa
MASPYYLDEEALKYIDYDLDVKIFTDGEKRLLDVEEYERHKRKMNYSDDLDYILKEHVKILVDWINNGRGPFSEAYVNIWYKRYVELKNR

What is claimed is:

1. An isolated polynucleotide segment comprising: a first polynucleotide sequence, or the full complement of the entire length of the first polynucleotide sequence, wherein the first polynucleotide sequence is selected from the group consisting of
   a polynucleotide that encodes a polypeptide comprising an amino acid sequence selected from the group consisting of SEQ ID NO:302, 310, 313, 390, 417, 418, 447, 472, 490 and 513.

2. A vector comprising the isolated polynucleotide segment of claim 1.

3. An isolated host cell transfected with the isolated polynucleotide segment of claim 1, to express the first polynucleotide sequence.

4. A process for producing a polypeptide, comprising culturing the host cell of claim 3 under conditions sufficient for the production of said polypeptide, wherein said polypeptide comprises SEQ ID NO:302, 310, 313, 390, 417, 418, 447, 472, 490 or 513.

5. An isolated polynucleotide segment, comprising a first polynucleotide sequence, or the full complement of the entire length of the first polynucleotide sequence, wherein the first polynucleotide sequence is selected from the group consisting of
   (a) a polynucleotide which encodes the same mature polypeptide expressed by a polynucleotide comprising a nucleotide sequence selected from the group consisting of SEQ ID NO:39, 45, 47, 109, 134, 162, 185, 202 and 224 in deposited strain NCIMB 40794; and,
   (b) a nucleotide sequence identical to the polynucleotide of (a) except that, over the entire length corresponding to the polynucleotide of (a), up to five nucleotides are substituted, deleted or inserted for every 100 nucleotides of the polynucleotide of (a)
   and, wherein the first polynucleotide sequence detects *Streptococcus pneumoniae* by hybridization.

6. The isolated polynucleotide segment of claim 5, wherein the first polynucleotide sequence is a nucleotide sequence identical to the polynucleotide of (a) except that, over the entire length corresponding to the polynucleotide of (a), up to three nucleotides are substituted, deleted or inserted for every 100 nucleotides of the polynucleotide of (a).

7. The isolated polynucleotide segment of claim 5, comprising the first polynucleotide sequence, or the full complement of the entire length of the first polynucleotide sequence, wherein the first polynucleotide sequence is the polynucleotide of (a).

8. An isolated polynucleotide segment, comprising a first polynucleotide sequence or the full complement of the entire length of the first polynucleotide sequence, wherein the first polynucleotide sequence hybridizes to the full complement of a nucleotide sequence selected from the group consisting of SEQ ID NO: 45, 47, 109, 185, 202 and 224, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65+ C.; and, wherein the first polynucleotide sequence detects *Streptococcus pneumoniae* by hybridization.

9. The isolated polynucleotide segment of claim 8, wherein the first polynucleotide sequence hybridizes to the full complement of a nucleotide sequence selected from the group consisting of SEQ ID NO:45, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:45 except that, over the entire length corresponding to SEQ ID NO:45, up to five nucleotides are substituted, deleted or inserted for every 100 nucleotides of SEQ ID NO:45.

10. The isolated polynucleotide segment of claim 9, wherein the first polynucleotide sequence hybridizes to the full complement of a nucleotide sequence selected from the group consisting of SEQ ID NO:45, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 mnicrograms/ml denatured, sheared salmon sperm DNA, followed by washing in 0.1×SSC at 65° C.; and wherein the first polynucleotide sequence is identical to SEQ ID NO:45 except that, over the entire length corresponding to SEQ ID NO:45, up to three nucleotides are substituted, deleted or inserted for every 100 nucleotides of SEQ ID NO:45.

11. The isolated polynucleotide segment of claim 8, wherein the first polynucleotide sequence hybridizes to the full complement of a nucleotide sequence selected from the group consisting of SEQ ID NO:47, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:47 except that, over the entire length corresponding to SEQ ID NO:47, up to five nucleotides are substituted, deleted or inserted for every 100 nucleotides of SEQ ID NO:47.

12. The isolated polynucleotide segment of claim 11, wherein the first polynucleotide sequence hybridizes to the full complement of a nucleotide sequence selected from the group consisting of SEQ ID NO:47, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:47 except that, over the entire length corresponding to SEQ ID NO:47, up to five nucleotides are substituted, deleted or inserted for every 100 nucleotides of SEQ ID NO:47.

13. The isolated polynucleotide segment of claim 8, wherein the first polynucleotide sequence hybridizes to the full complement of a nucleotide sequence selected from the group consisting of SEQ ID NO:109, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:109 except that, over the entire length corresponding to SEQ ID NO:109, up to five nucleotides are substituted, deleted or inserted for every 100 nucleotides of SEQ ID NO: 109.

14. The isolated polynucleotide segment of claim 13, wherein the first polynucleotide sequence hybridizes to the full complement of a nucleotide sequence selected from the group consisting of SEQ ID NO:109, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:109 except that, over the entire length corresponding to SEQ ID NO:109, up to five nucleotides are substituted, deleted or inserted for every 100 nucleotides of SEQ ID NO: 109.

15. The isolated polynucleotide segment of claim 13, wherein the first polynucleotide sequence hybridizes to the full complement of a nucleotide sequence selected from the group consisting of SEQ ID NO:185, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:185 except that, over the entire length corresponding to SEQ ID NO:185, up to five nucleotides are substituted, deleted or inserted for every 100 nucleotides of SEQ ID NO:185.

16. The isolated polynucleotide segment of claim 15, wherein the first polynucleotide sequence hybridizes to the full complement of a nucleotide sequence selected from the group consisting of SEQ ID NO:185, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:185 except that, over the entire length corresponding to SEQ ID NO:185, up to five nucleotides are substituted, deleted or inserted for every 100 nucleotides of SEQ ID NO:185.

17. The isolated polynucleotide segment of claim 8, wherein the first polynucleotide sequence hybridizes to the full complement of a nucleotide sequence selected from the group consisting of SEQ ID NO:202, wherein the hybridization conditions include incubation at 42° C. in a solution comprising: 50% formamide, 5×SSC (150mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:202 except that, over the entire length corresponding to SEQ ID NO:202, up to five nucleotides are substituted, deleted or inserted for every 100 nucleotides of SEQ ID NO:202.

18. The isolated polynucleotide segment of claim 17, wherein the first polynucleotide sequence hybridizes to the full complement of a nucleotide sequence selected from the group consisting of SEQ ID NO:202, wherein the hybridization conditions include incubation at 42° C. in a solution comprising: 50% formamide, 5×SSC (150mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:202 except that, over the entire length corresponding to SEQ ID NO:202, up to five nucleotides are substituted, deleted or inserted for every 100 nucleotides of SEQ ID NO:202.

19. The isolated polynucleotide segment of claim 8, wherein the first polynucleotide sequence hybridizes to the full complement of a nucleotide sequence selected from the group consisting of SEQ ID NO:224, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:224 except that, over the entire length corresponding to SEQ ID NO:224, up to five nucleotides are substituted, deleted or inserted for every 100 nucleotides of SEQ ID NO:224.

20. The isolated polynucleotide segment of claim 19, wherein the first polynucleotide sequence hybridizes to the full complement of a nucleotide sequence selected from the group consisting of SEQ ID NO:224, wherein the hybridization conditions include incubation at 42° C in a solution comprising: 50% formamide, 5×SSC (150 mM NaCl, 15 mM trisodium citrate), 50 mM sodium phosphate (pH7.6), 5×Denhardts solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:224 except that, over the entire length corresponding to SEQ ID NO:224, up to five nucleotides are substituted, deleted or inserted for every 100 nucleotides of SEQ ID NO:224.

21. An isolated polynucleotide segment comprising a first polynucleotide sequence or the full complement of the entire length of the first polynucleotide sequence, wherein the first polynucleotide sequence hybridizes to the fall complement of a nucleotide sequence selected from the group consisting of SEQ ID NO:39, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:39 except that, over the entire length corresponding to SEQ ID NO:39, up to five nucleotides are substituted, deleted or inserted for every 100 nucleotides of SEQ ID NO:39; and wherein the first polynucleotide sequence detects *Streptococcus pneumoniae* by hybridization.

22. The isolated polynucleotide segment of claim 21, wherein the first polynucleotide sequence hybridizes to the full complement of a nucleotide sequence selected from the group consisting of SEQ ID NO:39, wherein the hybridization conditions include incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; and wherein the first polynucleotide sequence is identical to SEQ ID NO:39 except that, over the entire length corresponding to SEQ ID NO:39, up to three nucleotides are substituted, deleted or inserted for every 100 nucleotides of SEQ ID NO:39.

* * * * *